United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 6

SEQ ID NO: 187 - DNA, 4551392 bp, Homo sapiens (residues 3,034,263-4,551,392 of 4,551,392)
  misc_feature (605630)..(655629): n is a, c, g, or t
  misc_feature (916740)..(966739): n is a, c, g, or t
  misc_feature (1174973)..(1224972): n is a, c, g, or t
  misc_feature (1367778)..(1417777): n is a, c, g, or t
  misc_feature (1882285)..(1932284): n is a, c, g, or t
  misc_feature (2085158)..(2135157): n is a, c, g, or t
  misc_feature (2307737)..(2357736): n is a, c, g, or t
  misc_feature (3555895)..(3605894): n is a, c, g, or t
  misc_feature (4155638)..(4205637): n is a, c, g, or t
gagaaaacaatcaggtgaccattacctctaaaacacctgatttgattcagttatcctataggaatcaagtatcaggctttacaagatcctcttttttcaatgttgttttactgcctaaaacaatgtttaagatgactaattcacgtttctttttgtgacttatttttacttgatctaatttctaaagtgatctttatgaggtgtcttgcctaaaaatttgcctatacttataaatgcattttcacttactacaatctcattttttactgtactgtagatgtacagttagttgaatgcatacataatacttttgagaatatatgaggttttacataagaagaatcatattgaagtggttatctagcatatctaaagaggaaacaacagagaagcaagctggaaacaatatgtagacatcagtaattattttaatttcacaagacaaacatttatcaatcctgtattcaaaacctacatatatgctacttaggatgcagaaatagctatgtacattcattgccaccaaggcatttatgatccaattgaagggcaaatacaaacacaatgaagtttctttgtgtagcaattacacaaataaaacttcataagcttgccaagaaaagcaagaacgaagaaaggaaagaaagaaggaagaaaaacaaatggcaaaacagagcaatatttaaatgtggttatgattcagccaaccattacatttaatgataatgtgcctgtttgggaaataaaatagaagaattaactgaatgccaaggggagggggaaggaacaaatgaaaaaatcaaaacaaaataaaactgtgaaagataattaatgggaatagaaaaaattatgtacaaaaagcattttatttggagagtaatttagatctttaggaatatattggctatattcaagttcctatacttaagtgctatacaataataattaaaggtaccagatttagtaaagggattttgcaccatgaatttttttttcctgtaaagatacaaatatatctccttagtagaacagataacctcacagatttatgacactgttatatatcaatctatatttatttatttaaccaagcaatcttaatgttattttgctaaattgcttctaaatgtcccagtttctcagattccctttgtgtcatttaaaacatctatttgttatttattaattcaagttaatatctttaaaacctattcattttatatttgtctgaaagctatgattttaagcttctaaaaattatattttaatagaaatcagggactagttacctttaatctgggggagatactacatattttaaagcctgaagtcaatgtctagacaaaagtttctgcttaacatcaaagggtatgcaacatttgctgtggctctcaaatattaagaaaggaaaacacaactgggaatttgtcactagcactttattctttactcaggattgaagtagaattttttgacgccaatatttttcagaaactttaaacattagaaataaaataaaaactagcccaattccaatattccccatggatttcctagcagaagaaatgtgaaactcttatggagaaataatccaatattgcaaacacaaggatttgccactacagaaactaacaagttaaattgaaaactatattaaaaataaattcacaaacaaaaattacaaaatacacaatgaaaaatgatatacatgccaggcgcggtggctcacgcccgtaatcccaacaatttcagaggctgaggcgggtggatcacctgaggtcaggagttcaggaccagccaggccaacatggcaaaaccccgtctctactaaaaatacaaaaaattagccaggcatggtggcaggcgcctataatcccagatatttgggaggctgaaataggagaattgcttgaacctgggaggcggaagttgcagcaagctgatattgcaccattgcaacccagcttgggcaacaaagtgagactctgtctcaaaaaaaaaaaacaaaaaaccagcaataagagtcagcagatgtaaaacagcagaattaaaagtatgtgtaaaaatagatgaataatttgaaaaaaattataaaattaataatatgtaatgaacatacataaacactaaagacatttaaaaagaaatgaagagcagatttggcaaaggatatccaaaaataaaaatatagtaattgaatttaaaaacctatgagatatggatgattaaaattaatataataaatatatatcacagagaaataaagttatcaatatagagcaagatggacaaaaattattattatattagatactttgggtgcatttaagatggtattgaggcaatatctagaggtaataactggaaattttctataagtcattaaagaaaaaaaattttcacattcaggaattggacaagttctgaacagaattgataaaaataaatccaaactagaaagaacactgatttggtgaatattttaaaaagaagctagttcactgaaaaactaatacaataatgcaatggcataccaagttccaaatgcaaaatatacagtgcaagatagaatactatacacagtgctgagactttttgggtctacaaaattttaagaaagcgcactcatggattcattgaacaaccctttttaaagtaacaaagaaagaaaaaagaaaacactaaaaaagacaagtgtgagaagcaagtggcaactgtaaacctgttaaatgtaagggtaaatctaaataagcattaattatttgaaaatgtgaggccaggagtccagtccaacctgggtaacaaagtgaggcatgagttacaattaaaatactagaaaagtattgaccatttcaattaaatgttcctttcaaatcactaattattttcatgttccaaaatttaaaggttaattttttattctcattttattgatctatcagtagtctctttttctttaattaaaaaacaaacaaacaaaaacacataaacaaacaaacaaaaaaacccagctttttttctttggcttccagaacacgtcctcttggctttcttcttatgtctttgtatgctatttcttagtctttggaacacttctgtgtccacccccactcccttgatgagttctcacagagccatggtttacaatattgtttatgctaagaacttgcaaatttgtacctctacctcttacttctcttctaaatgccaggctcttacatccaacttcttatgctgtcttcttttgagaagctaataaacatctcaactttgaaatgcacattctcacctacgaccatttgtctcaaagcaaaaatcttagagtcaatcctacttattttctttgtcaagaattgcacatcccacctttcagcgagtctttctgcttgctctacattcagaatctatccaaagttagtcactctcttagtctctcccagaaacagatcccagtaaaaacattcaatcagaagtaatttgggatgtagagaaaaactatattctttttcttccctcagccttttgatgtgtttatttcaatgctatttttacaatgttacttactgaatacattaattaaaattgtaatctgccactattactgtgtatcctgccttactttattttcttcacaaaatatataacttttcaacacctgtctatattttatttcttttgtgtcatcctacatctcactgtaatctttacaaaggcaaggatttttttctttaatatcctaaatgtagatgtttgtctctagtagattcaatggtgcctcccaaaatatgataaatatgcacatatctttccatatgctagcccacagaaactgtagatgtgacctaatttttttgtatatattaataaggatcttgagatgacgtcatactggatgatcctagtgcaccctaaatccaataagtgttcttatgaaagacagaagaggagaagatacaggaaatagaagaaggctacttgaggatggaagcagagattggagttatgcagctacaaaccaaagaatgccttgagccaccagcagctgaaagaggtaaagtaggatccacccataaacacttgagaaggaaagtgggcctatctatacctttatttcagatttctgccctacagaactgtaagagaatatatttcttttgctttaaacatttaggtttgtggtaatttgtcataacagatccagcaaactcatatactggcactgagcagatattcaataagaattgattatgaattatagtcattatgatagtgcggcattgactcagagatgaacaatttgttcactggactatagcaggaaattcaaaaattcatggtagactttcgatattttacatatgaattgtcgtatcacccagaaaaatgaataactattcataaaatagcagtgatacatttgattaacatatagaaaaattgtaaattgtattctatcatcacattaacttcaaatgtgaaagacatcttgtatcacttttaaagaaaatataaaatatattttatttagtaaaattgaatttgtagaacgatgactttttttttactttactgcttaatacttgagaaattctcctctttgatgaggctattagaaaacaggaactctaacaattatatagtgggaagataaattcatacaacgactttggaaagctacttgacaatgtaaggatgaaagtgcccaaagttgtaaaatttccctgctctatgtgtatcctatgaaaattctaatatatataaacaacaaaacaataagtatttattgtagctttgtttttaacatttacaatggtaaatataaaaatgccaatatttcctgatatgaaaattgatagctttatattatatatataatgaaatcccatatagaaattaaacaaaaacagatacccaagtatcagctggaatggttctcaaaaatatcatagtgagattataaagcatgtgttgaaataatacagagaaaacaataacatcttatttaaatttgaagatacaaacactaccatatacggtataaaatattctatacacagacctgtacttaaaaatagagaaatatacaaggggatgctaaacaattttagcctgtagttatcccttgtagaatttcttataatcttgtttctggttatgttgctgtatcaattatttttcagttttgggtatgtgtgaaatatttcataaaaggaagttggacgttttaataatacattgactttaagaggaggaagaataggtgattggggtattttgttatataccaacacatgactgaaataatcatctattctaattctgttcagttcagtggaaagtctttgaagcttttttaacagagttgcactttgtcatatctttgagaacattgtgttagattaagtggaacaggaatgcttagagggaaggagattaaaataatgtgttgtatggatatttgaggtgacatacaatagaactggaaaataaagaaacttcatgaaaaatagtataaaaagagacataaatgacttaccaattgactgctgtgtttgatagatgggaattgtagtcgtaacattggatgaaataggaaagacagactagtagagctctttggaggcaaattctataagttctttttacattttgagtgaaagttttcacttttaaatgaaatgcatatggataaaaaataaaggtaaatatagttattatgaaattgtcaagataaaatgagagttgatgcataaaaatgaatagactggaaaaagggaactttttaaatataaaaaaaattgcctcttttctgacagtattctttcttcttaaacttcatgattgttcctggaaattaaagtgaaaaaaaactatcataaaactatgactctatcatactgtaacacttcagggcccatattattatacctcctctgtccatctcgcatgactgtttaaaatggttctgtttgatacactgacactcaatttctttttatatggaatgtaatttgggagattctctaaacaatctgtataatggcagacatggagtacaactgaaattagaaatattctgttgtagtttccattctttcttaaaggttttaacattttgttatgaacatgacaagccttatttttttttccacacatagaaggaacacgaattataaatagaacaaaacactgtgaaatactgcaaatgtggaataattatttgatctcatgcacacacctcggtaatttaaattaaattctataagtaaatgactaaatattttaaaattaactactttaaattaagatgtatttagaaataattttaatgttattgaaatttttttaaaaaaactattgtaatataagaaatcatgacataatgcaaatactacatattttcagaaaatttggtaataaatatcatctcccaaaaaaccatcttagtcattgcataaaattctacaaatgatatctgattttaatttagaggaaagtacatgaactgaaagtcccgactgaataaatgcttaaaaaaggatgatttaaaaaaatttaaaggtaacatttattaattaaaataattctgatagaaaatcctaacaatgtacattattgtctagatttataattccgtaaattaaatatacatccccctgcaagtggcaatacttcaaaaattaattctagtttacaatttagtataaaataatgtattagaagtgtccctgaaagatggagtttaatggagaaaaatgaggaatattatgagtatcaggacatggagaagagtaaaaagtcaatattgtgggacaaattaaatgacattaaaaaatcaccttttttcatttgatataatgtaatggttataaaatatctcctcagagttcttcaactgtcatttcattgagatgtggggactggggtctctgaccttgaatctgggaggacttttaacttctttgactaagagaatacaaaaaaaatcaatgctgtgtaacttttgagacctggcctaaatcgacaatctgacttctgctcactttttttcagactcctccatctcaggagggccccagtattgccaggctgggagaaacccaaaccatgaggatagaccacgaataggagttctggttgacaatcccagttcattcctagcttcaaatacacaaggccaagtgccagatatgggcataaaaagcaattttggaagtggacactccagtccaagctgtcctagccctcagctatttgagttgcatccagacatgtaaatcttcccagctgaggcctcatcattgaggtgcagaaaaggggcatgcccactgtgcctgtttctaaattcctgacccacagaacctgtgagcataatacaagtttactattttataccagtaagtttggggtatagtattatgcaacaatacaacctgatgcacaaaaaatctcttctttgttacataaactctatataaactggcatatgcttagttcttaaacctctctccaatctccttctctttccccatactcaaactaatctttttttttctgctccttcaacaaaccagcacttgtatttacacattagataaattgcaccattaacttaaaaaacacaatttccaagatttttacaaaactgtgtcttatagtttaaagtatctcagcctttaagtatcacttgttagataacatttagttgccaatctttataattgctttctcttactctactccttagcttacagtcctttctgccatatttatcgtatttgtataacagatcaaaatctgtggttatctatttatttacctaattttcagctctctccacttattatcatataagttacaaacatttcaggtcatatcttcagtttaccacactataccagtagcttaaatatcacattacccatactagccactcaaaaatatttattatggaattaatggaactctaaatttaatctggtctccaaactaaatatatggcttaagtatcaatataggtttcaggtagatagggtttagctataaggaatacagggtgcaactaaaagcagttttcacaggcaagatgtttacttacttctacaaaagaaagtacaagccaggacaggataagaagagcagcctcacagggacgctgaagatttgttatacacatgcagggacattaatagcatttccttagaaagaggtatgatataagatagcttgatgcctgtagcaccctgagacatgattgctcatattgcagccaagaaaaataggaaaggctgaagcagcaaagggcaaaggggcaaaaggccaaagccatgcaggccaagtttgtgcttttttaaaggctttcttaggaacctatcttatgatatccatttcaatgtcacaaaattcacatggccacaccaagaaacatggatattttactttccaaataaaaaactaggcaagagaagtttacatttgcatagcctatcaatagtgtctgccaagatatttccattttttagtgtatcagaaaattgggcacacatgactaacgtacttttttcattttaaatagaaacaaatgtgtgtgcatatatatatataaaatatacatatttatatgtgtgtaaatatatgtgcatgtgtgtgtgtgtgtgtatgtaaaaccaatcaacttctgctgaaaaacttctgtaaaactcattttttttttccagtatgtttcctctgaagacaatcttcacatctagggaatattaatggtaataataacagcattgatttattgagagttttcctatgtaacaattactatacaagtatgccatttaatctatttctctagtttcaatattaatattggtacttaataaacgagtaaactgaaaataataagtttaaaatcttttttcacagctagtcagcaatacaactgggatttgatatcagattcatacgattccgaagaccctgaccaccaaatgcaaaaggtacatggcaacagctgattgcaatgagagaaaaacaactaataaggcaacaagcaggatactaagatattttccaaaatgaatagcactgattctgtgaggaatgaacattgccaaacaagtgttttgttttgtttttcaactcctctaaaaaaattcacatatatgcatgccactttcctgaaaaatatctgcctcataattgccataagaaacggtatggacaactcttaaacattctgaaagtagtcagggatgggggaaagcatttgctgttttagtctgttcctggtcttataacaaataccacaaactgggtaatttatgattacagaaatgtatttctgaaagttcaggagttgggaagttcaagattatggcaccaacatattcattgtctgatgagggcctgtttcacagatgtcattttgcatgacttaatcacatggtaggaaaagcaaagggacaaaatggacaaatgccatgttgtcacatggcagaagaaatggaagagccaggaagctctcagaagcttccttaattaggatattaatctcattcatgagtgcatagccatcatgacttaattgcctccaaaggccccacttcctcatcactttgaggattaaacttaaacatgaatttggaggaaatatatccaaactctaggactagtttaaatgtagctaaaaaggtttcttcattctgtaatcgttaatatgctaatatttttgtaaatatccaagaggaagctaaagcatataatattccaaaatttatttctgtttgtggatattatgttttcctctcattctatcttaagaaattagtgtcctcaagaaacactatataggataattgtctttcaagttcatcaactaccagttcttgattcttcagtagctaatcctagatagtaatacttaacagattataaaaacttgggtgctgctatataaatgcgctgaaactcccagggaaccaaacataaggacttaaagagagatgtaactagggatcataatcatgaatttcagctgcttctctatctttgtcagtgagcaaatgaccatacaaaataaggtattcaattattaattctgtgcccatatcccggaattttgcccaatatatttgtaagtttagataaataaggcactaatgccagggatatgtagcattagttctgggtttataaagggatattcacaacctcttgccatccacagaatttatcagcccaaagtaaactatactcgttggttaagggcaacctgagacatgtttaaaactgaggtggactgaagagtcaactaattgcaggaatcttttatttggttgaaatgttcaaacaagtcccactctgaattctattagaagtccatcattggcttctctctctttctcactgtcttaaatcatgtattttataacactatgaagaatgaagttcaaaagaataagctaaatttaattaattaaattatttatttatttattttgagacagagtctcactctgtcacccaggccagagttcagttgcacgatcttggctcagtgcatccttcacctcctgggctcaagagatcctcctgaagcagggcatttccctgaccccttcatgggactcgtgacaggggtgccccatttactcagcccactgctctcaactcctcaagggagggagtgcgcaattgaacaaggcaggaactggagtacacgagtgctggaaccagtggcctctttggtgccagaaggagtgaactcacccactctgacctgctgtgttccacctcttgcaggagagagcatgcaggtgagcaggtacaggagccaggaagagagctttggggtgttggcaggagcaaactccatgtgggccccatagcagcccctggggttaggggggtgcctgtgattcctgaagccccagtgggcatattacagtgctcctttagctctgccgtcttcagacagctgaagtgttagcagctcagcatgcctttttgtatccacactcactcctgagctcttgtttggcatccaggaaaaaatcagctcacagaaacgaattgaaggatggtaaatgcagaggattttattgccaaggaaagtggctctcagcaggaagggcagctgggaaggagatgtagcaggaaggtttctggctggactcttctccaaagttgcactgtcaagctgtctctctgaaatcaagctgcttctctccaacgtccaaccgtagtctctgatgcccagctgctgcttctcttttgatgttcagctgcttctcttttttgctagctgagtctggggtttttatgggcacaggatgggggacaggggaggtcatgggtaattttgtaaaaggcaacatttgagtgggaaaacaggaatgtatgttctcactttgggctttggttccaggcttgagggtggagccgttgccagggacctgccctcttttgcccagaatttccctgcctcccttccctttcactcccaccccatcactcccacctcaacatcctgagtagctgggattataggcgcacaccaccgcatctgattaatatttaaattttttgtagagacagggttttgtcatgttgcccaggccggtctcaaaccctgggctcaagtgatttgcccacctcagcctcccaaagttctgggattacaggtgtgagccagtgtgcctggccctaaataatatttatatgggcattttgtaattattattttttaataatataaatgtttcctttttaatatgaatttttcaagagttttataattgactgattattcattaaaatttaatgaaggacaggaattggctatttttctgaatgacaaaaattaggaaatttttagagagatgatgaatttatcctagaatatatggaaagagtaaatcttgttatatagaacaagcaactttccaatccgaaggatcttagaataataaaaattttttttcttataattgttttcttataattgtttcaaagtaatactttagaccaaaaattgtatatctcagtaggtggcctatatgataattaaaaaattaaaagctaagttaattaaatttttaattaatttaatttttattaattttaattatcaatcttcattgaagaattttgtccaaaaaatgtggacaatatgtgtcataaggattaatcaccataaaatagtccccaaaggaaattaaaggactgattagatagtactaaaataacaatcatacaaagtagaaagtggtgttataagagaaatgtagataaaatattgtaagaaactaaagtaggaagataatgttttgagttgtgggagatcagggaaggttttttggaaaaagtaacgtttaagctagatcttagagagacatgacttaatagaaaagtaggcaaaaaaatatgaataaccctttcagattacaggcaatacaaattatgataaatataaaaaaattcttacttcactagtaatcaagtaattgaattaaacaattggataccattttttcttcagcagactggcaaaacataagatgttaacaagggttttgagggtacagggaagagggtaggctcaaactatgctggtatcaatgtataaccaagatctcctttggagtacaattgttatatagtctacattctgtaaaaactaaacacatatgtttgcctttccacttttggaaatacatggtagataatcatgcaagaatgtcaattgcagtattgtgttgtaatttttaaaaatactctagatattcatcaatatataactacaaataaaaatagttggactatcatgcagactacaatgcctctattgtggcataatagttaataatacaatctctgagagcagaatatctggatttgaataatttgctctccctctaaatgaccttgagcaaagtacttacaatctttttctctcttccataaaatggagataacagcattgccaatttattagcttgtcatgatgattaaatgagataatccatatatcacaccaagtacccactacgtaataagcaactaattaaatttgactaatattaataatttcattattattcatcttaatatcatggcatgacttctaaggtatattattaaatagaaaaagataagttttaaactgagccatagtttagaacttgacttaaagcagactcacaaagcaaatgctcatatctaggacaggtaaatctacacgtgtttatacacacattcactgtatttggggaaaatacacaccaaactggaaacactggttgtctctgaagaagagacagggctttggcaatattcaaattaggctttaactgtttctgaaagtttcagttctctataaggagaaggtattacttatgtaatttttaaaaattacatattaagtactaaatgactgaagcttcttagaattgatgggtgcaggcatcacatgggcagcaaggcattcacataatggagaatcatggtctcctgtagatgtctaggagtgataaaattaactaccttttaggtggtgtagtttcctggttgagctgataattattaagttaatgattagtaggttatttctcaacaccgaagagattattagtgtttcaaagttttcactgtaattcatctgtaaaaccattcaacctacctccagtacacctcagtaatctggtgacaagagagtattcttgctcactttatttactcttcagtgatctaatgccaataatgccagcctatagaaacaacagccaattataacaaaaagcacattagaaagtcaaatatagctgggtaatagacataaaaataccttattaacatttttataacactctgaactgaaataaacagaccactctcgattttagcatctggttccaaacaattcttgtttgggtgataactttttaaaaacaaatgttgggcatctttcatcgacttttcatcaagtaacagctgttcctttagagcaaaatgtatgcatgttggaagtgtgactgatgctcacttctgttttgttctgtgtgagaaagctttatgttgggtgcaattcagaaaacaaatggtttcaaatcttttgaatagatgccatagcacagtttaaatgcagcttcttgtgatttttagaataatttcagccacaatttttacattcaatttataactatactaagacattctccttcagaacaaaggcatttctgttttcatgtgctcttgggcatcttcgggtcattcattatatcaatcatttatcttcgtaaagcgtttggctatgaacaattacttactacaccaaagcatgaaagaaatagatatagctcatctgctcttgaatgcatttctacagattcccttaggataattcctgtttcaacttaagctattaaattttttgctgcattcaaatcacctcatctgctgaaacatgtggagacaaataaccacagacgtttgcatgaaggttcaggtgtatttaagggcagcttaattataagacactatgaaattctcctaattaatttggagctaaatattctacatcaaatattttacaaaacttaaagaaatatttacttttcacatgattacgattttgatactaggttaaaaatgacttatactggcattttttaaacagtttaagacaaataatgtttttgatactgtttattataacatatgaaaagtctttatgcagatatactctattttatcgtctgttcatttcatgttgcatttgcatgcactcctgaattacttgttactaaaacatacagaacagacagaaagttaaaattggttaatttctatctaatctggataagataaacacaatgagtgaaataaataattatgtcaaataacaaaaacctcatgcatagaaacttcaacatttctgaataacaaaaagtataacattatgtagggcaatgttccacttttgtatcaactagaaataagccctgaatctgaatgatgaaattttaatagtaactgttgaccacagggcagagtttactctcttggtcagatgcttttgtgaatgacacaaactgtgtgtccagatcacttttccctataatcacttcaaattacttgactttttgatctcttccttttttctgtctcttttttgtccacaacagatattccaaatatccaccgagttttcaaatactccagtccatatttggtcttcccattcctagcagaagtactttgtcttctacttcccagaataatgttaattctcttattttagacttgcttgctttaatttgtatttattcttggctttttttctttccatctcacaggataagagggcatctcttcttccatattcataaatacgttgccaacaggaatttgttgttatttacactttcttctcctagacattttaattttacttaccttccctgagcacatggcaaagtcaaaacacaagcagaatcttacttatgaatagaggcagatttattaagccaggggtaggcaaactatagccaatgagccaaagccaggctgccacgggtttttataaataaaattttataggaactcagccacagacattcctttacatattgcctacagctgcttaagcactacaaaggcaaagttgcatatttacaacacaaataatatggcctgcaagcctaaagtatctactatcgtgccctttatagaaaatgtttatcagcttttgttctcttatcctaagttatgaggcttacatttccggccacctcatttgcatttgagtttccagttttgagtttgtagttttgcattcttgcttaaagagccccaaaccctgaccgccaaattgaatgtgctgtagatcccacaaaatatggatccaatcaagctgatgccatgtcattatctgtagcttttattctttgccatcacacaccttccttgaacagttaggcttctgcaaaaaatcttaaataatcactgatatgggttggttctgtgtcttcacccaaatctcatcttgtagctcccataatttccacgtgttatgggaaggatccagtgggagatgtctgaatcatgagggcacgtatgtcccatgctgttcccatgatagtgaatggatctcacgagatctgatggtgttaaaaatgggagtttctccacacaatctcttttttgcctgctgccatccatgtaagatgtagcttactccttgccttccaccacgattatgatgcctctccagccatgtggaactgtaagtccaacaaaccactttctttcgtaaattgcccagttgcaggtatgtttttatcagcagcatgaaaatgaactaatacagtaaattgttaccagtagagtggggtgctggtggaaacatatccaaaaatatggaaacgacattggaactgtgtaacaagcagaggttggaacagtttggaggactcagaagaagacaggaaaatgtggccaagtttggaacttcctagagacttgctgaatggctttgaacaaaatgctgacagtgatatggacaatgaaatccaggctgaagtggtctcagctggtgataaggaacttgttgggaaccggagtaaaggtgaatcttgctacattttagcaaagacactggtggcattttgcctggccctatagatttgtagaactttgaacttgagagagatgatttagggtatctggcagaagaaatttctaagcaggaaagcacttaaaatgtgaattcggtgctgttgagggcgttcagttttataagggaagcagagcataaaaatttggaaaatttgcagcctgacaatgcaatagaaaagaaaatcccattttctgaggagaaatccaagccagctatggacatttgcataagataatggggaaaatgtctccaggacatgtcaaaggtctttacctcagcctctcccatcacaggcacagagacctaggaggaagaagtggttttgtgggctgggcccagggttcctttgctgtgtgcagcctagggacttcatcccctgcatcacagcaactctagctatggctgaaaggggacaacatagagctcaggctatggcttcagagggtgcaagccccaagctttggcatctcccatgtggtgttgagcctacaagtgcacagaagtcaagaattgaggtttgggaacctctgcctagatttcagaagatgtatggaaacgcctgaatgccgaggcaggagtttgccacataggtggggtcctcatggagaacctctgctagggcagtgcagaaggaaaatgtggggagggagcccccacacagaatccctactggggcaccacctagtggagctgtgagaagagggccaccgtcttccagaccccagaagtgtagatccactgacagcttgcactgtgtgcgtggaaaagctgcagacacttaacaccagcccatgaaggcagccaggagggagactgtaccctgcagagccagaggggtggaactgcccaagaccatgggtatccacctcttgcctcagcgtgacctagatgtgagacatggagtcaaaggagctttagatttgactgcccttctggatttcagaattgcatggggcttgtagcctctttgttttggccaatttctcccatttgcaatggctgcgtttacccaatccctgtacccctataaccccattgtatctaggaagtaactaacttgattttgattttgcagggtcataggtggaagggacttgccttgtctcagatgaaactttggactgtggacttttgagttaatgctaaaaagagttgacattttgggggactgttgggaaggcatgactggttttgaaacatgcagatatgagatttgggaggggctggagtgaaatgatatggtttggctctgtgtccccatccaaatctcatcttctagctcccataatttctgtatgtagtgggagggacctgatgggagaagactgaatcatgggggcaggtctttcccatgctgttctcataatagtgaatgggtctcacaagatctagtggtgttaaaaacaggattttctctgcacaagctctttttttgcctgctgccacccacataagatgtgtcttgctcctttttgccatgattgtgagtcctccccagccatgtggaactgtatgtccaataaacctttttcttttgtaagttgtccagtcgtgggtatgtctttatcagcagtgttaaaatggactaatacaatcactctatcaaatgagataatatttattcctttaccactgacaactctctctcggctcttctattcaatcatgttactgatagacgctttgctttttgtttttgttgtttaacctgattgttatagcttattttatgaatttctgttcttcttttaattttacaacaattttactatttctccttacatgtttataagtcatatggagactccttctcatctaccctgaccccagaatattaaaacttttcagagtttcaggattaattccattatatggacatgattccttgagataggaaaaactgattggattgtgacattagacttatcagaatctaagatcttacaaaatataaagctttactagtaatttcacgaactcaggtaatcattaggcataggcaaatcagagaattatttagatctcttaatctgattctttagatccttggttctgtcattagatactcccttgcccaggcagatagatgagacttctagagaggtatgcagacaatttatttacatggagatacctgtctcaattatcaaatatcttaatttttatgcagatagttacatatgtggtatatgtgacattttccagggagccccataaatccacaaccttctactttgttaaccataagcaattctaaacgaccaagtacattctgctaaaagcatttctgtgatagataatcactctcctgccagcaaaaaaacaaattgtttgtcaggagctgtcattagtatgtttatataagcaaaatgggcttccttccttctgtggatcctggcagggcatctcagtaatcagaaagaatcaaagaccctttccttcccaatctgctctggccttggtcaacatcttagtgccaaatattgctggtgtattatcattattgtcttacaccattttctgcagtgtttcacttaagccaactaatactctgaccttgatttgaaccatccaacagagagtaggaattccctccacaaagcatgttactcattaacatcttcctttacaagtctcttgatgttcattcacaaactcaattacctttttcctccatcaacctcaattatttgcatcattttccatgggcctatgggagtatttaattgaatacatattttttcttctcaaatcaaattttctgaaaaaaatttgtttctatgaactgtattttaggtatattccaggttggtacaaacactaattttcaggggtcattatgtcaaagagcccatccacaccccatggcctacatatgtcaaaggattgttctttattcatccactttctatgaattccacacacgggagataaacttctttttcatccatattaccagggttgtcagggagcaacactgaaggtcacagtgttcagtgaaaccttgccataacttagactaaacacgtttttcccataattttacttcttcaaattctttctttttctttctttctctttctttctttctttctttctttttctttctttctttctctttctttctctctttctccttttctttctctctctctctctctctctttttctttttctttcttttttttttttttgacagggtttcactcttgtcacctggctggagtgcagtggcacaatctcggctcactgcaaccttcacctcacaggttcaagcaattctcctgccttagcctcccgagtagctgggattacaagcacctgccaccatgcctggctaattttgtatttttagtagagacggggtttcgccatattgaccaggcttgtcttgaactcctgacctcaggtgatccacactcctcagcctacctaagtgctgggattttacaagtgtgagccactgcgcccgacgttgagcttgtttctttatgaattcctgcaactcaacattaaagacataatatcccatagtgattaatatatccaatagtccttcctgactaaaggtacaaagttaatcctagtgttgttaataagcatggaagtcattatttattcagtgtcttcggttcaagcattgtcttaaaccaaactgattttctactacaactgagtcctctaaaaacagcttcctctagtgtccctatttgaagtagcaagtcatttttatcataatgatgggcctcctagaacactacttcaattagatttaatatcacatgaccaaatcctgtaattctttcaaaatgcctggcaaaggggccagtgctgcttaacttgccactcatgtagttcatattatgtgctaattaaatgtgtctagtttgaaagcattgtctacacctacaaataatgtgcttcatgaaattctcaattaggtatatcctagcaccagataccgttttatctggctgtgccataggcttcccttaaatgtcctctacttacctcttgagggagttatttataattttaaagcattaaagcaaacataaaatcacattctctgaggctttctaggttctagttttatattatttaaattaattccatttacattcacactgatatgttcaaagcaacagaccagatcaagctgtgacataccagacaggcagccactatctgctttctatcataaccagggagctgtcttagcaatgtatcattttgatttatggccatatagggtgcagaaattctattctacagcatcctctgctctgtacaattcattggtagtttctctggaaaaaaataatctagaatggtaaacaaagcctagaaactgagtgataactgtagtcaactacacacaagctgagttgtcagggggcactttgtcatctgttttattcaaattatacaggtagaacatccaaatcagtaggagtccaattttccttttctgcagtaagcaggccaagagattttcaccaacaaagcccatttgtttggatgacaatagcaaaagatagttaagtatgatatcctcactctgagctgtttgcatgaaaatattgtagtggcttccctccacggtaatgtaatctacttataaacacctttcccatctgctatgattttaccctatttccaaatgcttcctcccaatatcaggctgtataactcatcatgcataatgtttgcccgcacaatcaataacaagaaccttactagcacacccaaacaaatgtttgggttttatttgtttgtttgtttaacttttattttaagttcatgggtacatgtgcagatttgttacacaggtaaacttgtgtcatggggtttgttgtcaaacaaatgttataagtgacagacaaaggacctcagaagtctctcctctgcttgataatggagctaccttcacctttagccctaattggttacataggaaggaacttttgatccaccacaaattacctttcagaaaaggcacagtcaaattaaatgacacaaatatcatgtcttgggtattgtataatcttcctctggtgcaagtaaatttaaaactgggtttgagaccgccattagaggccaaataaaagtattagaggtgggaaagatataaagttatatattattgcattctccttcactccctcattattacctcttgatattagtaaggcacagtggattttgttatttatttctcatattagtctcaggacgcaatggtttcactaaatgaacccttaataatttttgagcaaggggccttgcttttcatttttcactgggttacagaagttatgtagctggtccttcctgttgacattggctgtgtcattcagtgcaacagcatgtgtctttcaaatggattatagcaaacagctgccacaggcatattttgagtcaaaatcctaaggagtctaaattggtggtctcatttaacttttcctaaagggctctagtttgggtatgccctaatatcatctgaccagttggatgggatcataagggcctaatgttattgcctgtgctaccacctaccacgatacttttcatgcttatttctgttcagtacctgcagtgagttaagtagtgctcttctgaaattattattcattcagaatctcagaaggtgaccttctttagaaatttgcacatacaattagttaagatgagctcctactagattaaggagggtcctaattccaatgactggaggtgtttttataagaagagaggacacatggagaagagattgaaaatgaaagcagaaattggagtaataaatctataagtaataaagctccaaaaatttgtaggagagagtagaacctaggcaggggcaagaaaagatttttttctgtggcttttcaaggaagcgtgaccctattgactccttggcttcagacttctagcctccagaactgtgaaataataaatttcagttgttttaagctacccagtctgtggtaatttgttccagcagccctaggaaagtactacaatgctgtattcacgttctgaactctttccagttattttgtgagtatgggtagacaagattcttagaacagtcttgacagtctctgagtttattgcttattggtgggtcctatgaaatataaattacttctcacagtttaaggaatgtcctaagttgatctgcactaatttataggatttagttggagtttaaggaatgtcctaagttgatctgtactaatttccaggaattaatttgcaccttgggctgtgccttaaattctagctggatttatcagccagcttctatttgtaatacaggtgactatggtccttaactcctctcctaatttttgctctgagaagaaaattatcatcataccatgaaagtagtagatgaactctatcttttaggttattctttaccagattatggaaatgtgataatgaatttttttaaaatccatgataagacagtaaacatatacttgtttctattctgcaaagcttaaaattttcctacttgaaatttaaaaaaaaaaactcttaggaggcccctgagattggtttaatgctctgttgtagctatctggaaattcttaataatttttgagtaagtatccatgcattttcattttatactcagctctatgaattatgtagttaatcttgataacatatcagagcctcttgtctactttattttctgtacattcttcatcctatcaggtacagatgaagcacgcaaatgaaccaccttgatactctactgtaaatgtccaggggctacctacttattgaccagttagaactacaaaaaggaagttaatgtggggaggggaacttccttctgaaccattttcttaattacaacagtagtctcttattgcgcccttggaattctgcattgcttaatatttactactgtggagagcttgagcaattccaaaggatcccatttggcagagctgattaaaatttggtgaagagtgagctcagtcttcatcctctgtggaaacacaaagacgacaatgtcccattcatactgaatgacaattgcaattttgtatttatgtaaaggtagcacaagcaggtaatattctctccaaccacacatttcaacctgtaacttcatctttaccttggtttcctccctgatgttctcttcatgcactccagatttcacttagagcatgtatgagactctttcctaccttccataaggcctactgtaaattctgctctacatcctaccaatgataagaaactttgaataccaccccaggtaactttgttcaaattatatatatggcctcagatccatgactggggctggaatgaacagacctcagttctttatttaattgttttcagattctacggctttaattaaggcagtaaactcagccccctgttcaagtatgttctgttctatatcactatcctcataattggatttgaactctttcagccacaataaataaagcaaattttctatgattctttaagggattggtgggggctacagtactcctctcctctgattcaaaagttgataatgtgcttttattttcttattaaaaattctatcaaggcttactttttaaatcctatttatattttcttcaaaagtaaattaattcaagtgagctgcctttctattttctcttctgatttttaatttctccctgttgtgcacatgatataaatgctttttctccgtataatcccatgtatagtaactaaacctgtatgtttgttactgttctctgaatatatatatttggccctcaaggttatataagtcttgtaagacagagaatcattagcttatcccattcactctatctcttattatttgtatcaatagcattaactaaggtgttttctctctggaaaatataaagcctgtcaacatttacacttgtatcattcctatcatgtgaaaaggagaatccaattggcaatttggagaggagtagtagcagttacccttctcagtataggactgacaaatctcaccttaacaactgcagccgatatgctgtcacagtatttggaagtgttttctcaaaagtttacagccatttaatgattagccatgaccatgaatagtcctttgcatcagataataatagaattgcaacatgtcctccatcattaatttgaagaatccatgccaatgttaattcaccagtcttctgttagtgaatactctgttctttaataaaatatagttttcactcatcacctgtccttggactccggttacataaatagtttgtccaataatcaatattttgagtcatttctaaggatacatgaaatttctccaagaaaccagggagggataagaaggttttccagtgaataaaatgtaatctcgcagctttttctcccactatcatctcctcctattaaaaactaacctattaaaaggttagcttttacaggtatgctagcaggagtcagtcaatgggatttgcacccaatttccctttgtccatgtactccctagacccgtactcccagactgtagtctatggcccccagatttcaatggtaagacttatttcccttaacctgcctcaaagattccactacctcataccaaaaatgtacagccaactatcctgagaacaaattctcatatttttccattatttccttttgaaaaggagcccaggtagaaaaagaaaacattcactattttggtgtgtgggtctaaaagacaatcctgctctcagtgccaatctgaacccacaaaaagcattgaattgtcaaatcggactcacattgaagattttgctcagtatcatgctttctgaataatttcaaagataaaataatcatgtatgggttaagtggggagagacctgtgtcctttcatcttcattgaatgtggtctcatccaagtttctagatttggtttctaagtaaaatgtacagttgctttacttactcaggtgtattctcagttacaaaccatctccttttatacttagatagcaacacagctaacgtgacattttcttgggaatcatcaccctacatttattgattcctggcttatttttcataagcaattttagacaactctgcatggtctgctagaaacattttatgaagaatgattctttggctaccaaaaactatttagtttattttctaagagacttgcattaatatgtttgcagaaaaattaaaccagaacacctgacttctttatttcccaggagttttcctccacacctgcccccatcaggggagaaaattgatcaggaggtaccacccctttccacaccattcttgaatctattctacagaactctctcacatggtctagcaatatgtttaaggtagaaccctttttctatcaatatttcttatgtgttaaatttgcattattatatgttgactagaaattatatattccttcttaaacattaatcataatgaatctaaaaacctaatttatttcaaccaataaatttctctttaattcctgtcctcaacattcttgtcctcaatattcctattgttactgttacagttatgaaatcatcttaatgaaatcacagctagaccagtgcattaatttaaaacaatagcatcctttttctataatttaacttcttcaaacttttcttcactgttgtataatgataattactctaaaatgacaatctgatcattaaaactttaatcatttactctctgccaatttcataaataaatatttgattcacagttgttatttcttcttcaagatacatcaaataatccacctttatgaaaagcaatttactgtttcataaatgtgctttattatgtcacatattcagtcttttaaacattttgtgccatccttggtcatcaaataaatttctatctactaaacatgactgacttagcaaaacgatagccttagtttcatgcatgtctccatcaattttggaattgcttttatgcccaaactgcagtgggagaaaaacacacaacaaaattgtgttgattgttatctctttaaaaccacaaccttgaaaagcaaatgtgcctttaaggcggccaaacaagcccatttttcttttgttagccattgccttcttcctcttatgtaagattaacttatggattctttcctcatttcacacccctcacatacttttcttcaatctcaatgccagctgatgaccttgtttcctgtgtcaaaaaataaatacatagatagataaataacaatcaagaggaaatgtatgcagactcccactactacatatacttaacgccagtatctaaaattacacactactcatcctgcatattaatagagcagggtcttttctctggtactatggacaaactgagccagataattctatgtttgggatggggtgttggaaaggttgccttgtatgttgcaggatgtttagcaacatccctggcctctccaattcgatgctagtagtaactccattcacaagttgtgacaacagaaaacatctccaaacattgccaattggctccttgcagagtgaaatctctccttaaagaaaaccactgccagaaatgaaatgtttatacacctacctcaagcttacgcctttacttgttcatcaactctttctgactacacaggctatagacagatacttttcaatacttacccctcttatacataatcaaattttcctctttattgggtcatttcatgatcatacaaataagctattacttctgtcatactagaaaataaaagcaaataagcaaccagtattcttcattttccccattttcattgtcagataccaccagggaatttgatccctttttcaccaaaactctttaaaaggataatttatagtcaccgtgtcatttgctccttgcattttctctttaatcatttcatttccatacagatttttgccccccactactctaattaaacctgtcctccactttgttaatcttatagttatttttctcaccttacttgatttatcagcagcatttgaagtagattattctcataatactatcttcatttgactccctggttttatattatttgtatacttctctctctctctgtctccctctctctctctctctctcttttagtgttttcttctattcctcagactcaatgttggaatgctccaggcctcagtattttatttccccccaccatcatctttctctgtacttctttccttggttatctcatccaatctcgtggttttacatgcagtgtaaatgctaatgactcccaaatttatatttccatgccatatctctatcccaaattccacacgcataaatccaattgcattttttacacttccacctgaatgtcgtgatgataatgggtctatttttcctgagacccattcctcactctgcccagttcagttcataagacagaggggatgaacactgtggattatgtagctcagattttctgaaagctggcttccagttaggctcaaacaataggagacacatgtagaaagatgaaaggcaggaacaaggagaaatctagatattgtctcattttctccctgtcatccctaataacagttacattttttacaggctcctgctcctttacataggcccactgtggttccagcttcccccaaatatccctccctgcagctccagtagtacagcctcctatccctgttctccaagggaaggtgatagtagcctcccattgttgctaaattgtaggttgcctcactgtcccctggttggctttaatttttttaaagttatttctaccatcaattacctgtatcaattccctttgttttaaattctcaatgatttcagttttcctggctagtttctgattacttcagatacctaatggaaatctcaaagaaagtatgactcaagagaaattgttgatttccatctcccagctactaccaaacctgtttatgcttatccatttcatttgatggcaagtccttcctctggttgcttaaacccaaagactttataatatgtagaatcaactacttctcaccatgtctactgaggtgtgaattactactgttttcctcttggataaagtcaatatctaaagaggggacttttcctaaaagtgtcctcttacagtcagttaccaacacaatatccacagtcatcctttttacataaaagagcgtgtcacttctcttcttaggacctgtagtgaccctctctttcattgatggtaaaattctaaggcagtgtgagttttaaaataccctgtaaatatgtacaattattatgtcatttaaatataatatatatttttaaaaattaaaaacgtatatcaaggcccaaattacttctgtgtgctcatcgttaactccccttcctcactcatctccagccacactggtttccttgaaccccttcaaacaagccagatatggggctgtcttgggcttttgcaccgtcttttccctctgcctgggttcccttctttcagatatctacatgtttaatccctcaccacctttaaatttttgcataaatgctatcttttcaatgatgttttctatggcctccctacttagcatctcaacctgtttcttggaccagcattagaaaatgaatatagagagatgaacacaatatatatggccctgccctcatagtcctagcaatctacagggacacaaaataatatgcaaaaaagtatttgaattatcttcagcacctttctaaagaaaaaaagctacttaaaacttacacttagaaatgctcaatatgagtcaatacattatgtcaccacctaaagtaacaagatgttaggctgcaactgctgtatgttttgaatgagactcattacactatgaagtcacatacttgtttaatattataataagacagaactaaatttaaatcatagttataccaaacactagctacactgaatctctacatctcaatgttctcaccagcaaaatcaagcttataataatactagcttcttcaagttatttaaaagataaatgagctaagacatgtaatgctcatagcccatttagaaaggcaaaatataaggtgtagtacatagaaaccactgaccattggtaattctgaaacactacaggtcagacagtttgaatgaaccatatactaaaggttggaaaagttatttgattaaactctgccttttttttttctgggaagaacacatagattaatcactttgtataatcccaacctctcccttcttgggagtggggataggggaaacagttttcatcatctatgatcttaagtttcctcatgctctttctcattgttaagacaataccacttattttagcttattgttacaatagtatttcatttttttctaacaacttggtattagtcaagatgggatataataacaaatgactcttgaaatcttcatgggtgccatgggaagtttcaagaacacaacttgaaagtgaattgcatgactttgttctgtgtttcattgaccactactcattcagtgagcctgaaagtaactgtgtatatcactgttagtatactatgcatgccagatacccaagactcaaacttttcctttcctttagataccacctacttagtcatcaattttggttcaacctactccactaaatagctttgacttccattcacttaccactttagattagtgctatagactcctattttacctccttcatatcaatccccttaaaactcccaatagcttccattgtttcaaccaaaagctcaaattcctttaatataaagtgttatatgaactggcaccctatatactctatatcctaatctctcatctttcatttatttctttaactcctgactcatgtaacaaaaatgtatttatctcagcacgtatgtactcccttgttatgctctcccaaatgtccctgtatttttcattgaatagcaattgccacattttattttatatgcttgtgttaccatttatatatatatttactacagactctgcttttagaaggcatacactggccaggcgcagtggctcacacctgtaatcccagcactttgggaggctgaggctggcggatcatgaggtcaggagatcgagaccatcctggctaacacggtgtaactccatctctactaaaaatacaaaaaataagccgggcgtggtggcgggcgcctgtagtcccagctactcgggagactgaagcaggagaatggtgtgaacccaggaggcggagcttgcagtgagccgagatcgtgccactgcactctagcctgggcgacagagtgagaatctgtctcaaaaaaaaaaaaaaagaaggcatacactgtgatatttgcaacatcaaacaaacaaacaaacaaactaaaattggaagaatacccaaaaataactcaaaggaataattttaatttcaattaattgattatggcctttatcattttaagatttttatatgtctacttttatgaactctaggctagttttttccacttttatttctacaatcatggggcctattttatattttctcttgcacttgattatagaagagattgaaatgagttaggaaacatgtacttgaaaccaataatgggcacactttacaggatttcaaaatctaaaaatatcataacataacttcagggaagagtaagaagtattggtgtcatttttttccttttagtagattagttgaagaggtaaattgaacatggactatatgtcagacttttttttccaaattatattcttaaatatatagtaaaacatatgctagagacagttttttaataacaaacaatatttgaattgagatcctgaagaaaaataaattaactgtgtaaaaatgtattactaaatatctgcattttctagagatgtatccttaagtatgtaggtataaaattacactctgagatatatttttaaaataatttggcaagaagagaacagggataccttaagcagaaacaacaaaattatgataattgttgaatatgtgtgatggttgtatgttaatgtattgattattttgtgtgggtatgaaaacatgataataaaatcaaattacaaaaaaataaaaaatacctcttgcttttttagcagcttattacattgtttataacagtgtctacagcgctatgattggtcagagccagagactataacatttaataaaacgagtcctctagaagctcatgggagttcatttacggcagcaaagacctatattaaatggactgaatatttaaggagtaattatgttgagtaatgtgtttatttatagttttaattatacattatcttttttggttatctttaaaatatattaagcttatgcaaataggatatgcatcataacccaggatctattatctgaattgcttatatacttataataacataactttaaaagaaagaatcaaaccatattgctagcttacaggttggatctttctagacaatagttatttacctgaatgtttatttttgttttgcatcttcatcagttaaaaccaacagttacaatacaaatgaaagttaaaaaataataatattattaatgtgaaatttcaatgtgcttagcaataaataatgggaataagaattatccaggatgtactaaatgctacaagaattatataagtctaatgaacatgatgcttttgaacttaagtaaattctatgtgcttaactatttttattgtttatagatttaggacttctgaatgcattcttttttgctgttatgggatattatgaattcaccttagtagacttttgcttacaggacataaaattaatttattctatgaattttttcttcttttcctaaaaatgtgtaagttctgtgatttcttggactaaaagatatctatttacatagtgaaaggccaggccttgtaaagatcgtgacagtattcaatcctattctcgtttttttgtttcaatgtgttgctagttatcttatctcagtgtattgtatttatataactgcatatttgattaagatacctaacctatgagacatattaacataatgaacacatgtaagcacacaacccaatttaagcataagaacagtatcaataattttgcagttatctttcactctttttcagtcacacagagacaactatactcttaattttgtgtttagagtcctctattttcttaatagacagattgcacatggttaaaggtctatgtttacatcaagagagcctgtgtctggatcttgttcaccccgcttatgtctcttttgaagttatgcttaagctttatcccttgttcctttatggaaatttgagtattttaggaaaagtaaaaaaaaaaaaaaaaaagaaactttaaagtagaatgataaaatctagtgtttttagatacagaagtgagaagctgaatacgggtaaagcatgatggactatgggaagaacggaatttcttgtgtgtgactgctcattcaataagctatattttttaaagacctgaacaggttatagctattggttatctacaagtggaattctcaaacacgaaaatgaaagcctgacaaataagatgctaatgccattttcacttaaaaaatagaacaagcgaaagagagaaataaaagcactagcccagtaagaacatcttctatttgccttactcataagccatttcagggccatagctgcaaaactaggaagaaactgctaagtgctaaaacattttaaccaatcactttaagaaaggcagaggaagcaaatcactctagtagataaaacaggagagactgaagttgctatagttgtaatctttttaaaaataatctatttgttttgaagaaaaccccaataggaaggtgttttcatttttaaaggtatctctcttcagatactatttaatactcaatgtgctaataatgtcaaaaattgttaaatgcgtatatatctgtatttcaaataggatagtttatcaagtcaggttttccaagaagctgatactatgcaattataagtcactcaaaaggttatgagaggaacgttagttaaagattaagaagaaaaagcagatctaagtgcagggagtcttcagtgatgcaagcctggcttctgtcaaaggaggggaagaaggatgagaatgaaagagtcacagcctgaaacacagtttaggaagttttggcccggacaataggagtctccagtccaaagtcttctgttggaaggttatcacaaatcttaaaaatggccttcatcaatactccgagcatgctcagtcattggccaggaacagccagagaaaatatggtctgagtgcaaagatagtcatacaaccagaaaaacagtagctggggctgcctgtcatccatgctcactgaagcaagagttgtgagtggtgaccacatatatcaaatatttctatgaaaaaaacaaaacaaaacaaaacccaatcaagtgaaactccaaaatgataacctttaatgcttattaggtggcacaagtgttaggttgggtattttactaaatatttaatcattatatatgcacatatttatgggcatgtgagcttaatttctgtttttaaattcagaatgcttcaataataacattgcattttatataatcctgattttcttttttaaaatcagctcaaaaggagaagttaaatattcagctttaatttcaccagtagatttttaatgttttgtaatcataatgtttaatttgtgctgttcttagaactttaattatgaagctaaattgtactaatacccattaggtacttcttaattgaaggcacatcatatgtctgatgtggcagtactaattggtgtaattaaattctaatatgcttcagtagcctgatttttttaagggaataaaaagctgatagaaataagtcagctcttgaagctgcatagttgtataatacatacacgtgtttgcatttgtaacatgcacatttattcagaagaaacaactcattaatttattccaaaaccatttcacctgataacttaaaatacagagtaaaacaaattggtcaggtaaatatacatgtaacttaaaaagaaacagtcatgtactttaggcataaggacaatgcttttctcttttacaaattctaagttaggtcaaattctctgaaagtcactacctttctttactgtgatgtgttttcggtgaagttacagcctatttgcaaatcacatcactggtttgtccaagcagaggtagatgagaggtaagctcctgtcctgctaaaagtctcctaaaaacagcaagaaaatatttttacatgttcaaaaatgctcatttatttatattcctaaattttcttttactcagtataatatagataatttaaaaataagtagaatatttttattatatatgttttatttttatacatctagttaaattaatagtggaacattatatatctgttaaatgttttaaattacatggaattaaaatatcaaagttaattatgttattataatttttaaatttcagaaaccttctttaaaattcttactgttttatcttaaaaaattcatatagaaattgtggtcagatgtaaactgtgactctgagcacaaatcccaatgctattgccaattaaattccaatttttgtgttcacacatgaaatgtagtttttcttttattgagttttaaaaatctgtaagatttacctatctgaatatacactcaggtctagcttcatgttcctgtgacctctgtggtcacacaaggacccatgtacataatgacctcatacttggcctaatgctctgctgttgccatcttgaaacgcttaacactttgaacgaggtacaacatccacttcattttgcactgggccctgcaaatcacgtagacagtcatatatgagtccagtattttcctaccaccagacattttgatgtactgaagagataaaaaaaaaaacctaataattagaagttttaaaagaattttttttttttttttggaagactagagttttattactgaaatcagtctcccccaaaatttagagactgcatttttttatttttttttaatttttttattgataattcttgggtgtttctcacagagggggatttggcagggtcatgggacaatagtggagggaaggtcagcagataaacaagcgcctctgcccggccgcccctactgggaagtgaggagcccctctgcccggccagccgccccgtccgggagggaggtgggggtgtcagccccccgcccggccagccgccccgtccgggagggaggtggggggggtcagcacccccgcccggccagccgccccgtccgggaggtgaggggcgcctctgcccggccgcccctactgggaagtgaggagcccctctgcccggccaccacccggtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagaccttaaaagaatatttttaagagttgttgtttgtttgtttgttttttaatcctagatgtctcaagcttgccttccattagataatgcagtaaggaacccccagtttacaacacagggcaggcaggaagacaaccaactcaatgggatctctgtcctgtgtagtcatcaccagctgatccttctttttctccgctaaggtggtgacagcgttaacccccattaaaaggacaggtgatctctcagtggggatgtctcctttgctttcttctcagcccaggccaacagtctctgctgcttctcttgctttgtctctggtctgtacttgccagccagcttaccccattgagcagctgtttggtggtccaaggccctggtgaactgactaatcacagaaggcacttctagctgcttatagaggatggctctctgctgctgcaacctagtataatggggccatttgacaaagcaagtgaggtcccttttgggctggatgttctgtccaatgccaaaatgtcctgtccagtgccaaatttctcaaatggaagattcaccactttcatggtctcctgctttttcaagaccgcaagggtcagcaccaccttcttccctttggccttctttctttttcgcaccttgggtagctggagaacagaataataagatcttgagagaaaaataagttgaagccagaggtaaaactgaatattggtaatatctttttgttttagggttgctttccattttagaaagtaattcagagtgttattttttaaaaatcatatatcagagttctctaataaatttcaaacttaaaagaacatttaacttcataagagaagagaaatgtttcatgaacatattttaaagatagggaaactagaatacaatttggagtaaaactaatattttaagtaacctggagataggactcatatcttttaatagaacatgcattctaacaagccagtgatttttcaaagttttctaaaacacttttctcaaaccacatttaacctagaagtagaaacaaataaaagacacaaaattagagttaattttattgtaactgggttggctccagagattatagttaggaagtgattacattaagctctacatatgcagcattctagcaaatttcaatgcagtagacaaaatctataaataatgtgaaacacatattaacatgttaagcataatatgcattcattgtcttcaacagaatagttctctattaattttttaaatgtaatacaattttactttaaaaacactgaaaaatcaacatatttcattaagaaaaaattataaatgttgcaaaatgatgatgaaaatatgtatagtaataattcccaactataacaattttgttttatctaatactggtcagctttccatgtgtccaagcattacaggacttttcattaagcctaatcctcacaagaacattgctttgagcgatgttccagagtggtagtcctttaaggcattagaacgatttgtgaaatccctaaaaatactaggggaaatattcaaaaaatgacaatagtgccattattcctcctcctcaaagagactatcagaactaaaactctttgcttcatgttcctgtttacttctgtcactttcaagtcacagaggtattatcagactgtcatcattgtatgactctgcttttccaacagaatcaattacctatcccttatctcacaacttgatagtgatagatattgaatgcttatgttctgattagcaaactctttttgcatttttaataacaacttgaactcctgatatgtctggaaaatataaccccttcaacagccctttcaatgggttgctactattttgctcaccccatcttcacctgcctaatcatgaggaggcggggtatatacaatttcagttaatttgtagttatcagtctattatagttctttccttctgaaaaccaacaagtaaataaaccagcaagcatcaccaataaactttgacagtttatggttcataacgtacgtctacaccaaactttccattcaaatgctttttcaaacctttgtttggtttctttctctattaagacaacttttgcttttggctttcaaagacattctctccattataaactctgtcgttattctctattgtgcttacctcaaactggtaactctttcaaatcttacctgtcagtttcttgaccaccatgcatgttaataacatttcttctctattttagacagcaaatgtttctcaatattaaaaaaaaaaaaaaatcctactctttggtcctctctacctcccatttcatccaatatcgcttgttcaagacctgaactcgtacaggtttttaacctgttgaagactgtcactctatggactctactctcttctctctcctccatagccttctcattgcctatcttccctacttgtccaggaaatgatgacatgtttcatcactataattaatccatttcaaatggcctttatgccaaatgattttattatatactctttctgtgccatgccttgttttccaaatttaccacagtacaaattttacaattagttttccattactgaattagtaccaatctctgtcttaaaaaataaatacagtaaaaaatgataatgaatttatttcttcttataatactatcactggtgcatggttagaataaattaatcttaggatgatataagcatttctccaaatggtcttcaaattcattgatttttttgtgatttcaatttccatatttattgttcctgttgcaattttttcagattttatatgtattaactcagaacacatacctcttatcacacatattttttcatgtaatttatctaaatcttatagaaaagggtacatttgcattttctcttattagactcctgatttcaaataatatattacttatgagtatttttctgtgctgtagttattcattctcatagatatgtaacataattccttttgcaaaggtaaaaattgagctatctcttgttgaggatttgttgatctctgtctaaagtttcaaaaataagaactttaaaagcaaaatgtaaattcctttcaagttttagtaaaattacttcaaacttagtagcttaaacaatacagatttattatgttacagttctgtaagacagaaatctgacttgatcacaccatggtaaaaccaagatactgccagggttggttttttcttgggggggggtctgtgggaagagtttgtttcctttggttttccacagcccagaggctgcttgctcctttgatcactgtcccttcctccatttttaaaatgaggaatggagtcagggtgactatggttagcaatattgtattgtatatttcaaaatagctagaagagaggatttttgaattctctcaccgtaaagatatcaaagatgtatgaagtgaagaatatgttgaatatcctgattcaatatttaaactatacatacacgtgttgaaacatcacactgtatcccataaatatgtacaataattatgtgtcataaaacaagatttaaattgttttaaagggccagcaatggcagtttgtgagttcccatctcatcactctaacttcttctgcctccttccacttgtaaatgtccttctgattattttggtcccatcaggataatccagaataactttcctatcttaatatcaactgacgaacaaccttagtttagtctacaatttcaattttcctttgccatgcaactaacatattcacaaattctggggactagaatgtggacacccgttgtattagtttgtcctcacactgctaataaagacacagctgagactgggtaatttataaaagaaagaggtttaactgacttatagttccacatggctggtgagccctcaaaatcatggtggaaagcgaatgagaagcaatgttgcatcccacgtggtggcaggcaagagagcttgtgcaggagaactcccgtttataaacccagcagatctcgtgaaacttatttactaccacaagaacagcatgggataaaccttccccatgattaaattctctctacctgaccccattcttcacatggaattattacaattcaaggtgagatttgggtggggatacagccaaatcacatcatttgtggagagctgtgattctgcctaccacaagtaagatgtacaaagcatggaaggagctacagccagaaacaattataccattgggaatttctagcagaataaatagcagttattaactgataagttaatagattaagtaaacctaaataattgccttcattagcagcgaggcttttgatggtccatgtatcacagatatttaaacacaaatacatttttctcatttattccaataacaaagtgttttttggtttgttttgttttgtttttgaaagtttggtatgagagagaaagagatgagctgatttgactactccaggctagaggatatgtagctgagagtctatggctgagtggaggaaaaaaaaaaatcacaagccctgtccaggataacagagagagaaagctgtttctgttgagatttgatggcccccatcacaccaaatttgggcttctagctagcctcagttcttcagataactgaccttccttctttcctccctcttgtaatagtctttgtgtattagaagtaccttgaaatgctgggtcagaaaatgtggcacgaaagagaaaagctggctcactccacatcttgacctgatcatttcctgaacatgattgaggtggatgactctttgctcctctttggctgacctgcaggaataacattgggaataagcaaatctcctttggactccagagggtggtggtcaggaagtgggccattgagaacctaggtggaaatgcaggccagattattggagtagtttgctttataatgttaaaatatttatacacatgttatgtgggcctctatttccactcttatcttagagcccacacgtattatggagggtctagcagtgtttgtggagtttttggtactatacctttttcaagataaagtaaaaaacatttatggataatttaattgttccctatgtagattccagtgccaaattcctctcttagacactgtttctagtataacatgttaatatgtgacccctgtttcacttacagatttttagagatctatcccaggttacttaattcaactccaagacatacttttcttttaaatgcagggaataaagggtcagttacttagttactccggttttatttaatcctactgtcatctgacaatatggtactgatactatttcctatttctagatggttgctagaaatatactgtaatatttattcttgatatatgtttgttactttaacgggaatacataggctataaatagtccccttgcctctcacaagttagacagtcctgcccagaatgccctgctgaagagttgtagcagatcaccctgttcctccttaacctctctgttccgcatatgctcacctgtaaaatagtgatcatagtaacacccatcttgtgatgatgtagagaggtttaaagaagcaaattaggggaggccaggcatggtggcttatgcctgtaattccagcactttgggagtccaatcacttgaaatcaggagttcgagaccagcctggccaacatggtgaaacccacttctactaaagcaaacaaacaaacaaacaaaaaacacaaaaattaactgggcattgtggcagttgcttctaatcccagctacttggttggctgaggcaggagaatccgctggacccaggaggcggaggttgcagtgagccgaggtcacaccactgcactccagcttgggtaacagagcaaggttttgtctcaaaaaaaaaaaaaaaaaagaaagaaaccaattagggtggaaacacttagagcagggtgttcataagttgtcaccctcttgaagcaattgttggacactattttaaaaatgttttacttctgagtgaaatgttgcattttattttactggaagattcttatgtagtttaagtacattttacggtattgtcaaagagcatgagcaaaatatttaggaaagatgagaccatatttcttttatttatgacattgccacaaaaaatcaggtagatgaatttgtattaagtttttgtaccaatttcatatctaaaatttcaaagaattttattgcaacaaactctttcttaccattaactcaaaaaaattctgttttaaattgacttcattccataagtctctacactactaatttggccagaagttattttcaatcctaattgggaacaacaaagatccacatgatatcctttcaatttatgatgttgaagaaagttgaattgtaataatttgagtgtgcagtcaaagcaattttcaatactatgtatcactgtagaaacaagggagaatgtcttggttaactatttaagtggcttgagtatggcaattaaaatttcatctaagctcattttgatgaatcttgaaggtgacatttatttcttatgctctgaacatcgtaagttctgttgatttttatgggaagttttcaaggtcattttcagagatctatgacaaaatgacattatttgagaaaaaaaagaagaaatagctcgaagtttaaagcattatggtattccctaagcccaaaattttctccctttacaaaaacaaatgaaaggcaaaatagacaaacaaagaaaccatcaaaaataccttgaatcactgttggtgggaatgaaaattagttcgaccattgtggaagacagtgtggagattcctcatggatctagaatcagaaatcccatgacccagtagtcacattacttggtatatacccaaaggaatataaatcattctattatgaagacacatgcacacatatgtttattgcagcagctatactacttattatagcaaagacatggaaccaacccaaatgcccatcagtgatagactagataaagaaaatgtggtacatatacaccatggaatactatgcagccatctaaagaactagatcatatcctttgtaggaacatggaaaccaccatcctcatcaaactaacacaggaacagaaacccaaacacctcatgttctcactcataagtgagagttgatcaacgagaacacattgacacagggaggggaacaacacacagtggggcctgttggggcgtggggggaaaggggagggagagcatcaggactgatatctaatgcatgcagcttaaaacctagatgatggtttgataggggcagcaaaccaccatggcacatgtatacctatgtaacaaacctgcaaattctgcatatgtatcccagaaattaaagtaaaataaaataaaataataaaaacaacaacaaaatgtaccttgaatctccaaaataagttaagacaaatagttaaaattgagcatgcttttattagaagaagaaaatgtcattgacaatataacagataatttatagatgggaacatacgtaaaaacgtataagtacttagatctgctagataaagtgagtcccaaatgataaggttacaaaaataatgtttttttgtagaatatgtgttttcaatgagaaagtgttgcaaaagtcagtcatacagattggtaacttttatgtttatttttcaaaagcagctcaaaatagttctttagattctgtaacaccacggtgtcctaattttgctcctaaaattttgtcacaaaagtttaaattcacttgcaaattgatcttcatttaatcttcctctaggtgtgtaagctaaatcagagatctgcatgaactgcttattactctttcatgctatacattctccctaggtaattttgatcactgcaatcttttccatcatcatttctacttgaagactaactaatataggtagaacaaatttcaacttctagacctatatgctttccagatatctcaaataaaagataaaatttggggagatataccatgttcatgattttgaaatagtcaagactgtgtgatattgtcctcaagaaagactaaatagatcaacagaacagaatagaaaatacaaaaacagatttatacatatagttaaaatctttttttttaaatagcaagtcaattcatcagggaaagtatcagctttgaagaaatggaagagttttcaaagcaagaaatgtaaaacagttgggtatttataagcaatagaaaaacaaatttgattcatagcttgcaaaatatataaacattaataaaaagccaacctgaatgtattgaaatcttagatataaacataagataaatctttgtgaccttagttgaaacaaataagtgctgtatatgacattaaacatttaatatgtaaaataaaatattaacttgaacttcttcaaaagtgaaaatttttactctttttaaaaaattattatactttaagttcagaatgtgcagaatgtgtaggtttgttacataggtatatacatgccatggtggtttgctgcacccttcaacccatcatctattttaggtatttctcctaatgctatccctccccaagccccccaccccctgacaggccccagtgtgtgatgttcccttccctgtgtccatgtgttctaatttttcagctcccaattatgagtgagaacatgcggtgtttggttttctgttcctgtgttagtttgctgagaatgatcgtttccagctttatccatgtccctgcaaaggacatgaactcatccttttttatggctgcatagtgttccatagtgtatatgtgccacatttgctttatccagtctatgattgatgggcatttgtgttggttccaagtctttgctattgtgaacagtgctgcaataaacctacgtgtgcatgtgtctttatactagaatgattcataatcctttttctatttagtaatgggattgctgggtcaaacggtatttctagttctagatccttgaagaatcaccacactgtcttccacaatggttgaactaatttacactttcaccaacagtgtaaaagtgttcctatttctccacatcctctccagcatctgttgttttctgactttttaatgatcaccattctaaccagagtgagatggtatctcattgtggttttgatttgcatttccctaatgacgaatgatgatgagcttttttttcacatgttttttggccgcataaatgtcttcttttgagaagtgtctgttcatatcctttgaccacttttcgatggggttgtttgtattttttcttgcaaatttgtttaagttctttgtagattctggatattagccctttgtcagatggatagattgcaaaaattttctcccattctgtaggttgcctgttcactctgatgatagtttattttgctgtgcagaagctctttaatttaattagatcccattcatcaattttggcttttgttgccaatgcatttgatgttgtagtcatgaagtttttgtccatgcctatgtcctgaatggtattgcctaggtgttctgctaaggtttttatagttttaggtcttatgtttaaggcttcaatccatcttgggtgaatttttgtataagatgtaaggaagggatccagtttcagttttccactacccagttttcccaataccatttattaaatagggaatcctttccccattgcttgtttttgtcaggtttgtcaaagatcagatggctgtagatgtgtggctttatttcttaggcctctgttctgttctgttggtctacataactgttttggtaccagtaccatgctgttttggttactgtagccttgcagtatattttaaagtcaggtcgcatgatacttccagctttgttctttttgcttaggattgtcttggctatacaacctcttttttggttttgtatgaaatttaaagtaggtttttctaattctgtgaagaaagtcaatggtagtttgatggggatagcattgaatttataaattacttcagcagtatggacattttcatattgattcttcctatccatgagcatggaatagtttgccatttgtttgtgtcctctcctatttccttgaacagtggtttgtagttctccttgaggagatccttcacatcccttgtaagttgttttcctaggtattttattctctttgtagcaattgtgaataggagttcactcatgatttggctctctgtttgtctgttgttgttgtataggaatgcttgttatttttgcacattgattttgaatcctgagattttgctgaagttgcttatcagcttaaggagataagctgagacgatggggttttctaaatatacaatcttgtcatctgcaaacagagacaatttgacttcctctcttcctgtttgaatacgctttattgctttctcttgcctgattgccttggctagaactttcaatactatgcttaataggaatggaaaagggcatttaaaaataattttttaaaaactatgaactgagaaaacatttgaatagcatatatcttattggccaagaaaggtttatctcatcaggactaatgtttgtctttagaactggcacttggctggcttttggaagataacctgtgggcccttaatatattctgcctgttgacagtgtttctatacatctttggctttagagtacagtgcacaagtggttttcagcgtctgaggccttggaccatgctgtgctcatttgaacagataagcttatcctaacaatataatttagagtcaatggctatattttctctgacagatgctgtagtctgagtagctgaaatcactcatataggcaccaccttacatgactgatgcccagtaaaagccctggagaccaaaacttaaatgagcttctctgattgacaacacttcaatatgctgtcaaatattgttgctgggagaattacgtgtgttcttatgggattccactgggagaggacacctgaaagcttgtacctgatatcttctacatttctccccatgggctttttttctttgttgattttaatctgtatcttttcattgtagtaaactgtaactatgaatgtaatgtgttttctaagacctgtgaatcattatagttaatctttgagcctaagggtggtcataaggagccccaacacactaataaattactttcataaagaatatataaaagctgtcaaaaatcaaaaataaaacaaatcacccaattttttaaaaggcaaaagattgaaaaagacgtcatgatagaagacatggatgacaaataagtatatcaaaaaattttaacatctgtagtcattaaagaattgaaaaccacaaagaaatactactgatagttattacaatgtccaaagtgaaaaaaaatattgaccctaccaggtatatgcaacaaaatggaggaactgaaacgttaatatacttttgattgacaaccactttgtaaaatagatagattgacagcttcttaaaaaagtaaacctatgcttaccacttaatctagtcatttatcttctagatatttccccctcgaaaaatgaaaaagaaattgttgtatataaatattcataggcattttctctttaatagctaaaatgtggtcatgacccacatattcattaacaagtaattggtgatatatacgtacagcaaaattctgctcagcaatgaaaaggttcgactactgacacatgcaacaacatgaatgaatttcaaaagaattttgctgtaaagcaaaaatgccagccaaaaaatagtgcaccttatatgattccatttatataaaacttctggatgcaccaatatacaatatacagtaatatacaatactgaaagatggtcagcagttgtctagctaagatgcttattaggagagacaataattgcaaaaggggattattaaaagtagtcatgaggaaacattttgtggatttatatgttcactatcttgacaataatgatgatctcacggatgtataaatatgtcagagcatatctaataatttatcttacatatttttggcttttaatatgttaattatagctcaataaatttcttaaaaactcattggactctatctgtaatgtgtgtatgtttagttttaagtagagtgcagctaaatttttctccaccattacaattttcaaacatactttcacttacagaatagcatactgaaaattaacacatgcttttataattataaataaaatagtaatatatcatttctgctgaaataaatgcaaaccaattacaaggaatttattagtttttattttagttacttcatatatattagcatctaagcctcaaagattcactatgtaattgtgtaaattagtagtagggttacctgaatctggcttaatagtgaattaatcagtatttatctttaaacattttttcctttatgaattgtgtcacacttttaaagagcccttcctacattacaagcatgtataaaatatattcttatactattttagaataatttcagaagttagattgttttctagatttagtgttttcattgataccaaatttatttttatgtacataaatgtatgattttaagttagattatttcaaactggtatccctgcaattatctgaacaaaaattttttttttttttttttttttttttttgagacggagtctcgctctgtcgcccaggccagactgcggactgcagtggcgcaatctcggctcactgcaagctccgcttcccaggttcacgccattctcctgcctcagcctcccgagtagctgggactacaggcgcccgccactgcgcccggctaattttttgtatatttagtagagacggggtttcaccttgttagccaggatggtctcgatctcctgacctcatgatccacccgcctcggcctcccaaagtgctgggattacaggcgtgagcgaccgcgcccggcccaacaaaatttttaagtagtcacattgacttttttttcaaaagttagttttaagctatttgataacatatggatctacttcactaaagttgtatttttgtgtgtaattctttaatccatctggagatattttggttgtttttcgatcagatagccagttaaaccagaaagaaaaatcttaccaaaaagtttccacttagaaaatttaatagccaaaaaaactaatatatgcaagaatgaacaaaaacatattgataaaagttatacatcatatttttattgaaatatttcataatgaaatgtttcacatggttaaagaactacaaattcatccagtgtaaataaaaacttcatgggaaatgtataatatatgagggattatttgatatctgaaaaaactagatagaaaataaatgcttaaaaacttctagaaggtaatccagtagagtatttatcagcttaggctaacaaatgatataaacatgattaaagaagagctaaacttgaataaaaatattaagttgatgacaagtgtaaaacaccattcttcaaaatatgcaattacaaataggaaagtgctaataggagaaaaaataagatgtttataatgcaaaaagtattaacattcaaaactgttgataatataaagaaagatattataaggaaaagtattccagtattagagtagcctaagtataaggcaatttgaagaaagaaaagaggaatcatgaataggtttatcaatcctgattccatctcaccagtgattagactggtaaataagaaaatgtgtgataataccaagggtaataaagatatatttcatttacatttacagtgctggtaaacatacactgtacaaccactttggagaaaacttggaagtacctaaaatgtgaaaatgcacagttgctcttgatccagcaagggtacctctgagtatatattgtggaaaaattctcacacatgcatacacagtgaaacatgtaagagtgcttatagcagcagtgttgggattttctttaaaccctagatttgacctatatatctatcagtagagaatcaaaatataattcaagctattgttatacagtgggatatagtacatcactgataattaatacaaattaatattacgaaccactcaagtttgaatcaaatattaggtcatggtataatgaaattataaaactatttagagttaaaaacaggcaaaaatgtcacatttattttagaattcataattgaatagtagaagaaagtaaaaatgcataggaatcatcaacatgaaacacaggaaaaataaatgaaacataggcaggtgattatctgcagagcaagaaagtagagtttattaaggagggcagtatgagaactatctaagatattttaggataagaagcggttttgtgaatttgaattcattaaataacgctttctattttgttttgttattcatcatttaacatttttttaaaaaatataaagaattctcataagtatttttaaactagaagacaaataagtggaatgaaacatctaaatgtcaaattttggtgtgtacttcctattaatttctaagcagggacacctggcaagcagaaataactctgaggacatgtgggattttgaatttttggacacctctgtaaagttatttggcaagcaataataatagctaccacttatttatcaagtgtttactaatgtactaagcattgccatatatggtttattacttctatcctatttagtattcaaatcaatatgatgtctatttttgttctgttttaaaaataaagaagctaacatgtccaagccacatatttagtaagtattggaactacatcaaaacaagaaagaaacatttcaatggtttatcctactgtctacttcctaaaggaaaattataaatttacagtaactgatccaaatacatttccagagttactttagctttcacagtgttggccagcacaatgtgttttttgtttgtttgtttgcttgcttccttgttttttaattgagaacattcccatagttgactatttcaatatttaattctccaatcttgtatttttggtttatcttgataaacatcaaataaggtggaggcagtttacactgaatagacttaagaagctgatcttcacaagaaagttcagatgcttcattttaccacaatttctccactgcttagttttattacacctagtccatatcatgcatttgggttacttgcctggctcatctatgacagaaaagaaggaaaggagaaaggaagcaaaagagaataaagaacctaaataaatgctattcatctattcagagctgtttcaaaaaattaagtgaatgttttcttcagtattctcagtcaaatcttgcttcatacttattataaataccctgaaggagtcataccaatgtgttctctgtaaatgccatgaacaacactttgtttttgtataacggttttcatgactattgtattaatagcacattcaataatatttcaataggtcaaaattatgtcatatgttttcttacaaatttttgtcattttttagaattaatgctacagcccagaaaataaatattattatgaaagcttgtttgtaaaaaatttcagtaattttatatctttttggtaagattagtggcttctattgtatatatttacaatggatatcaatgttgatattgagttatccaatctaatattcttaatagctccagcttgaactatgaatggtagatgactatgttctgtacgtataccaatatgagtatttttctatgttaaagattttactagaatccttaaataaaccataatcatctaatatgattttctgctggaatttatataatttattatcataaaaatatattgaattgctcagataaaaattttaacttctataaatcttaatatataaaaatatggtcttcttcaacaaattgacattgcaaattggtttagaatatccttaaataattatagttttattttcaaataagctacttttgcaaattgttatcatttttaacttaacttttgtgttttgttttttgtttgtatttatgtcttccccaaatgtcctctttttttatgcaaatgtagagaaggcagacacctagaattccatcctagaattaagacgtgacaataaactttgattttgtgagtgcattgtacgctgacctaatagaagatgaaaagtggaaaaatttgcacaatgagttcaagaactctgaggaaaagtattcaaacagtctagttaagaaaaccttattaagtggaaatttcataccaaacaaggctgcacagcttggaaaagccctgcacttaaaattaacttcagccggtgatgtgctgaggctcttgactcaagtacaggcacacgggctggctatgatttggagaaacatggtaagtcatatgaatgttagttgataactaattttattgttcatgtgcggaggacatagggtcaaatgtgccccaagaagacctcgagaaaatatatgtggctctggatacagacctcatgtgacaaaaggaagcaataaccaggaaagactgattctctctgcttatcatttagaacaatcaaaataagtttgaaatgaaaaaaactccaggggttttgaaattattaaactggcatgtacatactaaaagggagccaataaggaatttactactaatagggcatgggggaaagcagatccaaagttctaattaatgttttaaaatgatggtatccatttgccagttttaagataagtccatactgctgaaaattgctctatgtttcttaccacatttatctatgtcagcatttattttacttctaaatttaattacaatttttaaattccattatacaagttatctcacatttaactatttgttacctttccttctcatcttacaatattacttctctacctgtcaaactatatacagtccagttcctattccaattatggctataattgcagtacaattaatcaattaattaacaaagcatagcaaaaaatcaaaagaactttaaaaaattatgtataattgtgatcaatgtggatgtttttaaatatgttcaactatttatactattttccttctcaaagaatcatcagaatgctgaacacataaaataaacattggataaattaaaaataatttttcattctaaacaatctaaagtaatttaagtatagttcctatttagacttaaccataacactttgaaaaacttgaaagaattcactgattttttataaaatttaaaattaatacatattacacaatttgtaatatagatttttactttgaacatgagggcattttaaatggagcttctttaaaatataattcacatataaaaatttcagaaaattttaaggacctttttctttttactaatgctttgattaggatttcagtctgcatacaaatttgtcaagattttagctgatactctttcaggaaactattttaatagatcattacctttccttatctctcaatgtcattagatatgtacattttaatcttaatttctaggacaaatatacatatctttttctgattatgtgcctctaagtttgataaaaagttcttgatgcaaccagtggactcaacacttctccttactttgcatttataataataggcttatagcagtttttttctccaaattaaagtataaatatttaatttttacttttaatttttaaatgttactcaatagtatgtttataaaatgacttctggaaaaacatgtctattttctatcatttattatgtcataattgagagaagcaaggacccaaattcatttaattataacacataaaactgaataaatatagatgacagatatgtgttctttgtttttacatatctgttgtaaaccatattactcagattatctcacttctttcaacttttctaataaaagcaattaccatacctatgtggaatgtattttaatagtaattcattttaataaaagttatatatttttaggaggtcaaaatagcaatttcaatttatgaaatgttgactttttaatcttattgacatattttctggaggcaaattgtagaactatttgaatagcaacagaaatttccagtggagagacagtcagatacgaaacttccgtgagaaaactgtatttatcagtgactgaaaatccttggattaggacctaactcccacctacttgttcttgtagatactctgtctaaatacagatatagatagatacagatacagatacagatacagatatagacatagatacaagtacagttacatagaaaaataatattataagatatcctgaaatatatataatatgttagtttctaacattgttttaaaagttagttgtttaaccaatcaaagcagaaacaacttaaacagactttacaaaaattcatcagatttaataaagttgtctattcgaagatagggacttctttcttttttaaaaattaaatgagaaagcaactattggcaaattcaaattcctttcttatcaaaacacgtattttgaatttttattgtttaaaacaatatagaatttgaattaatagctatcttagtaaggaaatatctttcctcaagactgcaatgtgctatcttgcatacaaaattaccaaataaacacagtgactgctgataaatttttacctaattatttaatatggttcccttgaaaaatgaatgattaaatgaattaaacaacagttaaacaattagattcagtatgaatattatgtgcatactgtacatacttttgtattttcaaggtcaatcattgcatagaaagaaattaatttttttaagaagttaaaaatatagtacttaatcttgaataaatttgttaataactagggcacattaaaatatgcctcaaacgtagtaaaattacattttaacatttatacaagaggttgtctagaatatcacaaaagaaaaataacctaaaaataaaaactttcccaaaacaaagactcaaaagcagcccaaaactgttacaacaataaaaataatgccacaatatttgtttctattttaattgaaaaaaggaaaagcagatttagttattactctaaatagatactttattgttgatttttctagatttaatagattcaatagtttgaacttaaaaccgtatttctcaattttactctaattttctaacctcaaacttaaaacacatcatttccctctttattttcccaccaaccacacacactagccatgtcattctatttgtatttacctcattctttttcacatactctttgtgtgtgattctgctttaccatcttttagaatatcttttctcaatttttcacctatatcaaatattgttttaatatatagcatattaatagaaaagctaaggtatagtaaggcaaacagatcggaagacaattgccattgaaaagatactcacaatttccaagagaagggagcatgtcacgccaggggagactacagggaagaactcaggtccatcaggaaacagagagagggaggaattcacgagcaagaccctagactgtggtgtttgcaggaagaaaccaagcagggtaaacaagcttaggaccggctcgtttgaataatttcagtgggctctggggcataagagctgtccctggttctctggtttttggccctagcgtgattaggacagaagcacagtggcctggagtgtgacagccctatagagtatttgtttgggaattggttagtttgtatttgtaaagcccatcttcgtgaggagttcaggggagacttcgtagccagaagctgaggcaaggtgactccagcatactatccatcttcaagaacaagatgtgtctgaattgctgtatgttataaagtttcgatgtctaatagagcaaatctttcatcctgttggttctctttgatttaatttgcttttttttctctctaagtactgttctcggaataagccaatctgatatgtgtgtcactattccaatgaatgagtagatcacactttatttttctgcttcttgtgaacattaattagttcagttttctgaaattttcaatgctattgtgattttttaaaattaacaatgctactttgcttattgtgtacttgtcaccagaaatgcaagagctaagatgtctctggaaatggaattcctgggtcacagggttggcacatgatcaacattattagataatgttaaattgttgtacaatgtaatcacattaatttgtatgccaatagtagtatataaaagtttgaattgccctacatccaaactcacacaaaaataaatgcagtctaaaaaaaaaattataatgtgatgtatatgaaattatattttgggctgggcacagtggttcgtgcctgtaatcccaacactttgggaggccaaggtgggcggatcaacagaggtgaggagttcaagaccagcctggccaacatggggaaaccccgtctctactaaaaatacaaaaattagctgggcctggtggtgcgtgcctgtaatcccagctacttgagaggctgaggcaggagaatagcttgaatccaggaggtggatgttgcaatgagctgagatcatgccactgcactccagcctgagtgacagagtgagactccctctcaaaaaaaaaaaaaaaaaaagaaattgtattttgttgttttatagttttaatttgaattaataataagctttggtaccatttcatatattttaacttttttattatttaaaaactctgcttaggtattttcctattttaatttttatgtctttttctaaatccttaacataaattaattgtatcatgaattttaatagattgttatgtacttgcaaatgttgccatgctgtttatgatgatttttcattttaccaatggtgatttagaaggaacagatactcttgatatgagtgggaccaaacttacaaatcatcttgctccagtcagtttttgtgctggtttgaaaatttttttcatactctgagattcaggctaaattgcttttaaaattttaaagctttgtgtttcaaatttatattcttgatgagatgtatagagtgagaatgagatacattgtctttttattataaacaatcttgctttagtagctactgaagtttacttttgaaattgtatttcttaaatatttccgttaattatagaaaattgattttgtattctattttatatccattaactttgctcatttagtaattctaataatcctaggcattcttcacaatgcattgtaagataatgtatacatttcataggatgacaatttttaggtacacttaatggtatgggactatagattattgggattttctttggtttaaaattggcaaactatttttaaggggaagttgttaacaatcactttctacaatatgtgactctctcttcaaagagtaaatcagagacaaatcttttttttcaaatttctttttttgaaaatcaataataatgaccctattttttagtttgaatggattctcattaatttaaaatgcaaatattttggactaaatgtttgtgtccctcccaccccaaatttaaattttgaagccctaatccccagtattatggttttggagatgtgggcctttggaggtcaaaaggttgagatgaaaccatgaggatggagtcctcatgatggaattagtgaatttattataaaagacacagaagagcactttcttgtacacttcctttgtctctgtctctctgtgtgtttctctatctctcttccctttgggaacacaacaaaaggtatctgtgtgacaagcatgaagaataccctcagcagaaactgactatgtgtatgctgatcgtgtacttcttagcctccaaactatgcggaaaacattttgttgtataagacaccaagtttattgcattttattacggcagcctgagcagtctaacaagaaagcaataaaaagtataagtaattaagatgaaactaaatttatcatccaaattctcaccataaagaaataaccattttcaaaataggtagaacaagattttacatattttcctaaagtttatagacagagataattgataaagattttatacaaactgactattaagaaatgattgtatttaattataacagaagataaaaataattttgtatagagaaactgattaacgtttatgcatatttgttcctaaagtacattcaaagttaagagaacagattataaaatcataacttagagttcttatagtataggtttcttacaagaagggaagaaagcaaaataaatttaacacaactaaagcagatcttgcagaatgtgattcatatatggacatgagtcagcttcctaaacttgaatctcagtgttatatagatgaacccactcagacagaaacaacattgaactagaacagaactcctttgacaggcaatgcacatgtttttaggagagcagactgtaagctttctctgagcctcagagaggcagaaggtaagaatgattctggggtatgcatcctcaagtttttgtttaaactctctgaataagtacctcataccattttgccggggcaaagtgagtggatggggaaagcaggccaagggcattatgtgaatgggtcacttcaaagggaaaaacatatctgaaacatggtagaagcaccccataactaactactttttcatgcctttggcctattggacttaaccattatagcaatgatgactcaaaaactacattaaagcagtgttaagaggaacattgacggtgctaaatgcattcatcagggggacaaaaaggtctcaagttaatgacctaacatagcaactaggggaattagaaaaaaagcaacagaaaagacccaaccccaaagctagtagaagaaaaaaaataactgaagtcagagaactgaaaaaaaattgttatctaaaagtccacacaaaagatgaagccaagagttttttttaataaacaatactgatagatcattagctagattagcaaagaaaaagagaagatccaaataagtataatcagaaattataaagattatattaaaattgatcccatgaaaatacaaaagatatgcagagactattatgagcacctctctgcacacaaatctagaggaaatgaataaattcctggaaacacacaatctcccaagactgaatcaggaagaaagtgaaaacctgaacggaccaataggaagtttggaaatggaattagtaataaaaacctacgaaaaaaaataaaataaaagccccgtaacaggtggattcacagctgagttctatcagaggggcaagggagaaatgataccaatcctactgaaatgtctccaaaaaatcaaggaggaggggcttctatctaactcatactacaaagccagcattaccctgttaccaaatctggcatagaccacggaaaaagaaaagagaaaactacagatcaatatctctgatgaaaatacaagcaaaaattgtcaaaccaaatccagcagcacatcaaaaagttcattcactatgaccaagtagggtttattcctgggatataaagttgattcaacatatgcaaattgataaatgtgattcaccacataaacagaatcaaaaacaaaaaacataggatcatctcaatagatacagaacaagccatcaataaaattcaacattccagccaggcgcgggggctcacgcctgtaatcccagcacttcgggaggccgagacgggcggatcatgaggtcaggagatcgagaccacggtgaaaccccgtctctactaaaaatacaaaaaattagccgggcatggtggcgggcgcctgtagtcccagctactttggaggctgaggcaggagaatggcgtgaacccgggaggtggagcttgcagtgagctgagatctcgccactgcgctccagcctgggcaacagagtgagactccatctcaaaaataaataaataaataaataaatgaaattcaacgttccttttatgataaaaaccctcaacagattaggcattgaaggaacatacctcaaaataataaaactatctatgacaaacccacagtcgccatcaaactgaacagcaaaagctggaaccacacccctggagaactgagacacgacacggatgcccacttttaccacttctattcagcatagcactgaaagtcctagtgagagcaaacaggcaagagaaagaaacaaaagccatccaaataggaaaagaaattaaacaatctctctttgccaatgctgtgattctacacatagaaaaccctaaagtttccatcagaaggctctttgaactgacaagtgaattcagtaaagtttcaagaaataaaaacattgtaggaaaataagtagcatttttatgaaccaaaatcattgcagctaataaccaaatcaagaacacaatccaatttacaatagccacaaagaaaatgaaatacctaggaattcatccaaccaagggggtcaaagaccactacaaggagaagtacaagacactgttgaaagaaatcagagatgacacataaatggaaaaatatccatgctcatggattggaagaatcaatattgttaaaatggatatactgcctaaagcaatttacagattcaatgctattcctatcaaaataccaatgtcattttttaagtaattagaatgaaacctattataaaattcatctggaaccacaaaagagcttgaatagccaaagcaatcctaagcaaaaagaaaagccagaggtatcacattgccagacttcaaactgtactataaggctacagtgatcaaaacagcgtggtactgatacaaaaacagacacacagaccagtggaagagaatacagcacccagaactaaatttgcccacttacaactatgtgacctttgaagaagctgacaaaaacaagcaatggaaaaaaaatccctattcaataaattgtgctgtggtaactggctagccatatacagaagattgaaattggacccctgcctcttaacatagatgaaaattaactcaagatagattaaagatttacgagtaagacctaaaactataataatactagaagaaaatctaagaagtaccctttttgatataggctttggcaaatggatgactgagttcccgaaagcacttgcaacaaaaacaaaaattgacaggtgggatctaattaaactaaagagcttctgcctaccaaaggaaactatcaacagagtaaacagacaacttaaagaatgggagaaaatatttgcaaagtatgcttctcattaaggtctaatatccagcatctgtaaggaatttaaacaaatctacaagcaaaaaatccaaaaaatccacctaaaaaatgggcaaaggacatgaacagacatttctcaaaaggtgtcgtaacaagcagacaagaaacattaaaaattgctaaacttcactaatcatcacataaattcaaatgcaaaaaccacaatgaaataccgtctcacaccagtcagaatggcaattattaaaacttacaaaaaacaacagatgttgagaagtctgtggagaaatgggaacgcttatacattgtaggtgggaatggaaactagttcagccactgtggagagaagttttgagattcttcaaacaacttaaaatagaactaccatttgacccagcaatcccactattgagtatatatacccaagggaaaataatttattttatctaagagacacatgcacccgtatgttcattgcagcactattcacaataccaaagcaatagaattaacctaggtgtccatcaatagagaattgggtaaagaaaatatggtatgtatacatcacaaaaaacaatgcagccataaaaatgaacaaagtcatgttctttgtggcaacatgaatggagctggagaccattatcctaagtgacctaatagaagaacagaaagccacataccacatcttctcacttatagatggtagctaaacattgaatacacatgttaagatgggaacaatagacattggggaccactagattggggaggaaaggtaggggttgtgggctgaagaactacctgttgggtactgtgttactgcctgggtggtaggatcactgggactccaagcctcagcatcacacaattactcatgtaacagtctttcattaacctataataaaagttgaaattaattaaaaaaacaaaacaactacactgtttcattgctctagatttctttttgtctccatttaattatggagagacttgcagagacagaaatgactgtcacgtgttcttatacacataaagccctagaaacaggagccacagcacatcatgcactggggccatatggggaagtaccagagtcagtgaaggcaaaaggagcaagactaaagcatgagccagagcctttaatatggttttccttggaaggaatgagtgagacagtgtaagcagctgagcaggtttaagactgggtagtgtgagtactttttgtgtaatttagtccctagtgttccagcacctgattctggggtgacgaaagcagagggataatgtcccagaccacaggagccatataataagagtcaagtgagggtgtggattctggattggttggtttgcatataaataacatgatcataggcaagttgtttagtatttctagaaattagctaaccctaggaggagcactctgtcttgaaacccatatggtctcaagatgtcaaagcaaaacaaaaacaataaccatgattaatacagcaagatggaataagctatatattgccttaaggaagaagttacttggctctctatggctgatcgtcataacctgaaagatttgttctcttgacttgagctggacaactggggttttatttctgaagcattttataggaactactcattgttcttgtttttgtcatagtagtcatgatgctggccaattgcattcaactcagtcttaacttcctttttatagcagccctctcaccagaagatcgcccttactacaaaactgcaaaaagttcaagaacatctcataatatggttgacaatagagacaactaaacagtctctaagtcgtgaagatttgaatctctaaacttccctgaattggcttggtcaatgcctcacaagctagttaatgacaaaatgggaggaggggtagccagaccatatataagaatagagttctgacccacatctttgtagcaaccagcctgggaagccaaaccacagcctctgcatcaaccagccccaaatgaataggatttagttaatgattgccaggttccctatttttgcccccgctgccaactcaggacccatcagagaaagtcaagtatgctttctgactgatcacataagatgctccatttccccttatttatttagtccatcttcagcttccccatacaaccttaaggcagagcatatccaaaagctttccttttccaggtacaaaactttcctattcctcagcctttctttgagtctctgcaaaacatatatgatgacagctgactttcttgttataaaaagtctgaataaatatagattctctctgttattattaggtgttatttatttccacaatctacaaaaaatcttcaggcagggtactatttaaaggtgcaatattgaaaaattccacataaaatcaggaaaaaagaaataatgttcatctcactactgttcttctacacattactgtaagcactaaccattataaaaagaagaaaaataaagggcataatgatcgaataggaaaaacaaaattgtctttacttgaaaatgagatgattatggaaaaaaacctaaggaatacatttcaaaagctactagaactaaataatatatatatatatatatatgaaatttatagcaaacaaggttaatatatgaaagtgcatgttgagtgttccttatccagatatctgaaatctgaaatgctctaaaagctgaaactttttgagagctgacgtgatgctcaaggaaatgttcacttaagaattacagattttggatttctggattagcactactgaatttgtaagtataatgtaaatattctgaaatctgaaaataatttgaaatctgaaatacctctggtcccaagcattttttaactcactatatgtgctcatttttttttaacaaatacctattaagcagacactatgaacaaaaactgtgcaaacattggaaatacataagtaagcaaggcagaagggcctcttgtattaaaaataaacgaaggaggacactagttaaagtggtaaggacagattttaatcagtaataatgattgcaacagggaaaagagtgcagcatgagttgaattcaacttcaatttgtatattggcaactgattgttttattttattttagattctaggggtacatctgaacgtttgtcacatgggtatactgtgtgatgctgaatattggacttctaatgatctcatcacctatgtagtgaacataagacccaatagatagtttttcaacagttggccagctccctctctcttcccttttggaatctccagtgtttatggttcccatctttgtgtttttgggtaccaaatgtttacctcctacttataagtgaaaacgtggtatttagtttgctgtttttgcattaattcgacaagcattttggataagcagttcttaaccggtaaaatgtgttgttgcatactaataatgaatcattaaaacataataataaattctattcacaatagaataatcacaagcatataattcttaggaataaaggcaacaaaatatgcgtaggtcttttatctagaagctaaaaaatattattgagaaattttaagaaaaaatagaaaacgtagatctatacatgttcttattgatatgttatttatattaagatatccatccaccttatattgatctacaaatgtatttcaactctgatgaaaatcacatcagattttactgcaaaataaaaataaacaatgtgatgtcaagatgtatataaatatgcagaaagacaaaggaacataggtaacttaaccaatcttggaaaagaatataatcaaagaagtaacattaaattattttaagatttttaaagctgcatgttaaaaaatggagcatccataaatatgtttatgtttaacatagatgatgaactgattttctatgaagacaaaggacaatagaaaacacatatttttacaacatatctgaaacaactagataaatttatgaaaatcaaattaatttttttatttctaactttttctgttgcccaggctggagtggtgcaatcatagctcactgcagcctcgaactcctgggctcaagaaatcctccttcttcagtctcctaatgcactggggttacaaatgtgagtcatcatgcttagcctaacgtcaatgtttatcccatatcatttacaaatttgcgatgaatccaatttgagatgctcataaacataaatatgaaacataaatataaaaactaatactataaagcatataagagaacaatcttgcatcttagggggcaaaatattacatctttagggaggcaaaaatatttcagacaaaacaaacagaaaatgtagccataaaggaaaaaattatataaatagggcttcctcaaaataagattttctactcatcaagagaaagcattgaaaaaaattaaaaggcaggacacagaatcagaggaattatttttaatacatacaaatgacttagaagatcttaataagtagtactattcagtaataaaatgtctaacagcctctccccaaataggcatgggtcttgaatatcttacaaaggaagatatgcaatgtcacatgaacaggcactggacatcattattcattaggaatatgcaaatatacatgacaatgacagccattgcacattcactagaaattatttaaagaaattttaaaatactgacaataccaaaaattatagatatgtagcaactggaagtctttttgtttcttaagagtgtaaaatggggcaaacactccagagaacagttaattattttcttataaagtttaaaatatatttttctttgacccagtaagttttttctctgttacgtatacaaaagaaataataactgatgccacgataaagatttattcaaaacttattagaacagttttattcttaaaactaaaccttgaaacgacccaaacaaccttcaataaaggaatggatacacgaattgtatatattcatacagtggacactacagtactcagaattaacaacaacaacaacaaatcagatattgacgtgtaacaaaatgtctgggcctctataaaatattatattgaatgaaataaaaaagttgaatatctattcttactatgttgaacaaattaaaaaaaattacatggcataaagttccatttatatgacattccagaagaggcaaaactaatccatggttatgaaaataagaatggattaaagatttgatgtgtgagtgagatttaagtggaaaggcatgaaggaatttttgaggtgaggaaaatgcctgtagcttgaatcggtattgattatatgggtctttgtatttgtccaaagttattgaattgtaaactttagatctgtgcatttcacagtttaaaaaaatttacctcaccagtgaaactctgtctacctaaagtctgcagaaagcataactcaagaatttaacataaggtcccctaatcacatgaaggtaagaaacagccatcttttaaacatttaaaaagtcaggggaataaaaaatccagtttttttttttttgaataactattaaacttatgccagtgaaagaaaataaaattaattttcacaaaagttgatacacatgactgaggattaaatctatattgatattgttgagattaaaatacaacgcaattttaataaacatttaaaacacggacatggtgtccctaacaatttgttgataggggagaggataatataaaaattaattttatgaatcccacataagtacttgttaaaaacatatgcctctgttctttttatttaggaatcactcacagaaagcacacattctttgcttctgcactaactctggaattcaatattagaaggctcaactgccatgaatataaatcaaattcatctgcatcccctatatcagactaaatgtgtttgtttctcagtattctgctatattccttgtattaattttaatagaatcaaaactgagatatggaagaggatgttatatattgaacatcttttcttccatctagcatacccaatatttgctgcatgggccagaaatatgagaattagaaatgcgtctttatttggggtccttacttcattcacaattctagatagtcttctagttatgacaaagtctaagaattttatttttaaataaattattatcatatttttctgttaccattttttggttggttttccatgcagtttgtgcctacttccaggaggaagacacctacacacatttactcttctctgctttctttacaaatttgaatatgaaaaagagagccaggaattgccaaaagctggttactccaagaccctaggcattctgtcaaaatctaacttggatgatcatgtaaaatacttatcattttattaatatcagtatgttcattcaaatggtaacaagattttcacttgatttctaaatcactgatcttaagtgaaaaatatcaaaatagaggacttcacaaatattatcatttagaacatcctcactttaaacaacctaaagttatttttaatgttgaatcaatcatactctgaccttctccataggaaaggaaaatgtaaatatcccagacagcagagagcaaactgtcataaaaataaaactgtactttcaaatagctgtagtccacagcacagctctaacccaaattgtcatttcaactgcttcacattattagaaaatacttaccttctagctttgaacatgaaagaaaagtactcttagtctatcagtttccctaactaggagattcatgtatttgttggggtcatataaagaaactgatagtgcaatttaataaggataatgcagagaggatttggagactctttgcaaagctgttgaagggatgagaaagaacacaagagactgcagtaacctttggttagagtgatttttatcacccctagtttgaaagggccagtggcaaagcaagtttactaactttaggataaagtagactcatcaggaaaagagcaaccacctaagcttaagggacaaagccaatcacccctgggaagccagtgttaaaaatacttgatcttgctctctgctttcctgagaatacaaatcattcactttaactcattgaattcactcagcagtcagaagaaaaggaagcctcttgttggaattcatactaagaagatcagaaagtgtagtggaaaagagaggactagaactgcaggtgcaagtagaagtcagtgtccaaaaagaagtgtatttgtattgttcatttgacctcatttattttagtatgcaagcgtatgcttaaaaatatttcagccttctttttactatatatgcaattcgtcattatttattaagagattatatattcatcattacttcaatgatctcatttttagctttcctcttctttattaatggatgcagtaacttctggcattcccctgagaatattaattctacttatttggaagtactctttttattgctctctgctgtctttcttttgtattttatacatctttcatttgctttatgttattttaatcttaccctatgcacttacaatgatggcacttctccgaatgactgttgattttcttcctttctttctttttttcatgttgtctacatttttttttcaaggtgagtttctgctagactgttattactgagcaatcctttggtggagaaggaggttcatgctgctacaggccacaatttgcctcatttgcagtcagatcaggctttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatataccccttcctgtgtccatgtgatctcattgttcaattcccacctatgagtgagaatatgcggtgtttggttttttgttctatcgcaagatcaggctttttgtcagagagaggacatgcccattaggcaagatgtattcagatatttccaactgatcgctgccttttctttctgattcaaattcccattctcaatatatttacctaatgtatgcctccattttgcctttttaagcaagactaaaaaatcaatacccttggaaaaaattgattaatttggctaacttaaatttaaagtcttcacttctagcaaaatagttttactacatattttttactatgagaaaatatgtaaactatgtatacgaaagcaaatctataaataatttagaaaaataaaaatatttcaatagaaaagtgggaaaatgtaaaaataggtacttactggaagaatcaagagattagttctaaagaccttaattatttatttaaactaatttaattaaaattttaaaaataattaaatttttcaataatcaagtaaaacaaattaaacttaaacaatagaaccttttattttgagatgcaaaagcatgaatcaaagacatctgtaaagcttaaatgtattcagattgtaaagctaacccatgtaaaccaaactaggccaggaattagactatattagcgccccagactcccccaagtgtcccttcctaaaagaagctcctctcaccctaagttttatgtataatttttttgctgtgcttcaaaaaggtatagcatgtatgcatctctgaacaacataccttagtgttttttggcctgctttgataattactatgaaatcctctttctgtattattttgtgccacactccttttgttcaacatatgtttatgagtgacagccctgttgttgcaagcagttgtaatttattttttttcactgctctataatatttgattgtttatatagatgagaattttctattttattccttatatacatttgtgttattttaaagtttggttgcttaggagcaaagtcaatatgaaaatacttggacatatgctctcagaattatatgcataagtttatctacaacatataactatccaaggaattttaggagcaaacatatgtggttacttatttaatcacagactaactttttttcaaatcagttgtatcaatttatacttcttcctgtggtacctaagatttcataaaattatactttcaatccatgggcttagcaaaataattcaaagtttaataatatcaaattgacatctgtaatttaagaccactttagatgaaaatttttgatatctattaaattttacaatgtgaataacttataagcacaattttccttaactcatcatctgtcttatgaaatactaacatatgtgcagtaaaatgcaataggatgtcaattacagctttttaaaaatagtcaaaagcccattaaatagattaaatgtccaccaatagagaaatggctaagtaaatatgacatatctaagagttaaagaaatgataaagattaacgtgtgttgaatcactaagatttccaatacatattaaattgaaaaataaaaacacattattgtggttacaaatacacaaagtattagattatcaaatcagactcacatgcatcggagatcttatgcaaacttaactaataattttatggataaaaattattgtgaggtacaggtggagcaaggtaaggtcagatagcactgtgagaatccctgggtcctttccttccacatcagatatgctttgaacaaggataatagatgatgattctgagtaagatgtgcggtcatctcacttacacagaggagatatttagatcacaaaatatctcattttgtctttagatggtccaggaaactacgccccatgagtcaaagagatttaggttttattataaacaaccctagaaaagaaatcacagcacatacattcttctaaaagcattctgtaggtaaggtattccttcctggaaacttcttagtttgtttgccaagaggttagccagttatatggttaccaaaaaacctgccttctttgtctcctgcatgtttcttattaaagagaatgaatgaattgcagaactattgtttgcacatttacttttaaatggtttatcagtaaaatatgtgagaatacatttttaaaataaacttatgtgattgctttggaaaatgtctggaaatacgcaaaccacactgataataatggccttctggggatgaaccaacacacaatagatttactggtaatcgtttgattttttcaaaagtactacgttcctgtataatttgcatgattaaaatgtatttaatataatttccacctgtgataattttcttgtgtataaataggacattgctcttgctattagcagctatatactgtaatatttatagttgaaccacagggtttagcagacttcagcccatacactgaacctgtcctattgcctgtttttgtacaacctgcagctaagaatgtttttatattttttgaataatacaaaaatatcaacagaataatagttcgtaaaacaaaattaacaaaatttaacatttgtgtctatgaataaagttgataatattgtaaccacagccatttgtttgcatattgtctactttcttgttacaacagggtttagcagttgtgacagagacttctacaatgtttccaaagcctaaaatatttactgtcttaccctttatagaaataaatactttgctgacactgtgactcataataatgtttgcaactactttttgaataagctcaaaagtttacagacacacactcctaaaatatttgttatattgctctttatagaaataatttgcttatccctgtgaattatagtgatgtatacaactgatttttgaataagttaaaaaatttagctggggcggtggctcacacctgtaatcccagcactttgggaggctgaggcgggcagatcacctgaggtcgggagttcaagaccagcctgaccaatgtggagaaacccagtctctactaaaaatacaaaattagctgggtgtggtggcgcatgcctgtaatctcagctactcgggaggctgaggcaggagaatcacttgaacctgggaggcggaggttacagtgagccgagattgcaccattgcactccagcctgggcaacaagagcgaaactcagtctcaaaaaaaaaaaaactttacacacacacacacaaacatggattatggattgagttgcatgtatttgaatattagttttgttattcttgcaacttattaggaggtttgacactttttctaaattacaattgggtgaaatttttgcaattgataaattgctagataacataatctagctcatattatatgataactttagatgttaaatcagcaataaaccttatgaagatctatgtttctaggaaataattacttcaacaagaagggaaagtaaagacagaaggtaaaacaaaatataagacgaaataaaataaagatgggaattgaatgccatagaagtgtggaagttggagggaaagtttctaaaattatttggataaaaaggaagccatatattttactgaatcttctagatgggttttaattctgtatcctttcatactcacatactatgccatttttttcaacttttcattccacttgcacttcctaacttatgatgaatttacctatatagagtccttttatcatttagactaaaattgtatttatttgaaggtaagaacggtcatatacttcttagttgttttcagaattgaaaacatggttgaggccaggcacggtgtctctcatctgtaatcctagcactttgagaggccgaggcggggggactacgagatcaggagttcaataccagcctgaccaacatggagaaacgcggtctctactaaaattacaaaattagctgggcatggtagtgcacacctgtaatcccagctatttgggaggctgagtaaggagaatcgcttgaaccctggaggcagaggttgcagtgagccgagatcacgccattgcactccagcctaggcaacaagagcaaaactcatctcaaaagaaaaaaaaaaaagaaaaaagaaaacatggttgaaagtcaatatccatgtgataaattgagttagaaagccaatgagagcttagctaatataaaggtgatggaattcactatcaaaacttttcagagacttagaaaaaatatggaaaattagtgaaaatgtaagagaatgaagctcgaaatcaagataattaaactgcaaactttaagaaggcaggaaagatatcctttacttagtttgtcttgtccaactaatggttagttgaatgccatgcacataacacatccctctgagtacttattgaataaatgtagaatgtcattctggaataaattgaggcaagaaactagagggatagcagtgtgaaaagtgagattaatttatttggtatagagtcagtaaatttaagtgggtcatttgaaacaacaagcttaaaagaaaaccaaataagcattttcaatgcatagaaatgcaaccatttttctccttctgtactttatccattcaaacattgcttgaaaaaaaatataactttcagtcttgcttttttatctccaccaaactcagataattttggtcgttgatgacctttctaagctaattcctattttagaatgctatggacgaatgaatctcaaaacttcttttaaccaatttattttattccatttcctaaggaatagaaactttttacctccaacccaggggagctatgaaacaaactccccatttatttccaatccaaacacatttgataaaacaggcagaggaattttttatcagatctgtattttaaattttcatgactgttgttcaagagtttccattcttgctcataaatatgtagaggcttaaaattcttttctgaaaaataaactgctactttaaatgattttaactcatttttataatactttttttattctctgatgatctcttgctgtttttctttctctagaaatgttctaagaataaattagctgatatagtaagaaaggttcacaaaatgagtccttcacttatacagcacctcttctaaataacagagagattacaaatccaatgtatttaaactctgagttgtctatatgtgtagtgttataaaatgtagctgtcagttttaacagcttttccccctgagatttcagtggctagctaatgatcttttttaagaattaggacattttctagatagcgaaatggcaggaaaacatatcaaatacatatttttccattatagtattctgaggactgtaaagtcttactcaatgtatatcacttttaatttttaggatacatagaaatatttgctagtagaaataaatggcaagtgtttacttgaagatggtttagaaagatgcttttctcttttaatttgaattgctactgtaaatgtcatcacatgtatttcagtattgtctatgccaactttgtacctgaaaaacagtattatgaattaggcattatattccatcttcataaattaaaaaagaaacataataactagcgaagtggaatgaggaaggtgtggggagacacagaaattttcaaaagtagtaacaaattcaagcatgtattagcttaatatatcataacttaaatgatttaaattaggtatatgtttataccaataagttttaaattcttaattcttacctcatcaagtaccaacaaagaatgcccttccatattaatacactttgggaattaagataaagtatatgtaattaaatcatcaaactccttttgttgtttagcaggtagtttgatataataagagaaattgtgttctcattatatatttgtcacaatgaatgaatgtaaaaccttaatcaggctatctgacttcttttagtgacatttccctttttgcaaccaacacatcaaattagtaatatttatcctacaaaaataatgtgaagataaatgagataagatatataatagtcacaaatacttattgaataaagctgtttttatttatatatttctatgtacttactagatatgttcttattaaatattttattatggtatatgtcaagtcttttactttttttatacttagtgtattatagaactcaccatccaataaaattgtaatacaattttcttgatttactaatcctaggtgaaaaaaaaaaatatatatatatatatatgttgttttctgtttgaattatgcttagttgatggcattttcaataatctctctgattcttccttttcctgtttaaactactctcattctcattgtggcctagagttctttttccctaatattgccttcagaaggctaagtttctaatataataacaatttgagtctttaccacttctctctagaatcgtgatttagactaggttattagagtaaacaatatgattccaaattttgtcctttttttaatgggctagcatccaaaaagcataagaattctggggggaaatgacataattaagctagattattttaatttaaattcagaattaaaaatgattttcaatagcttctttgtcttaatttaataagcttttgttgaacattgattatattttgaattctattttttcttttgtttttagttggcacataattatacatatttatgggatacagagtgatattttgatacatgtatacaatatgaaatattctaatcagagtaattagcatactatcaccttgtacatttgtcatttccttgtgatgtgaatattcagaattctatctggtaggtttttaaaaaaattcactgaattattgttaacttaattcaccctacagtgctacagaacgctagagctattcctcccttctagctacaactttgttacaaagttaactttgcttaccaacctctttccatcctcttcttattcccatcctttccagcctctgataattacaattctacttgttacttttataagctcatttttagctcccacatataagtgagaacatgtggtttttctctctctgtgcctgtcttatttcacttaacataatgtcctccaggctcatctacgttgtaactaataacatgatttcaattcactacaaaagttaaaaggatactcaacagtgccaaacattctattttagtttcccaatgcattcactcccacagcattcataacaataaccttctacaaagttaccacatgtcttatgctaaattgatgagatctcccaatattaagtaaattctgtcccttagctctccctctcattttagtattatcattctcattaatgaataattccctttttgttaaaagtttacattgacctaccgttgtccttcagttatcaacttactttgtattctttctttgaaagaaatcaatcaaacaatagacagtctccttcaatatttcctgtactgtcttcaatccacttagctgagtactttcttttttctctacttactcactttttcccctgagtgttctcaagcattttcatgagtttaaaggccagttacatgatagcatctcagaatatttccaattttggtatcttctctgagttagagctttgcatagtcatctacttacttaatatcaaatgtggattgttttatagacaactgaaattcataatgttttaagtagagttttgttattttctctgcttcccagtttgtgtgtgtatgcttgtttgtttacttcagctggtgttcccattgattttatcttatctaatacaccaaaaccctatcagtggctcttttcttcaaacttgcacatatcttaaatatgtatttcattattttgaacaaggtctccaccttcttgtcgtttcactttaatagttttctaattcatttccttgtgtttattcttgtccctgtaaaaattattcttggtttaagaggcagagatatatatgtattataaacacagggaaacaaattagatataaaccaattactataaaccaatgtaataataataatatatattacttttttctatttttttatttcttctttttcttttttattttttgtaatgtaagcaagattctttccctcctctgccttaaatcctttagttacttgtggagtacaattacaaatctccaggatgctaaagctctgctctgctgtctacaaccacaggcaccattcaagaccctcactcctaatgagacagggctctttccactcttgaaacacagtttttccccatggcagggttttgcacaaggtaacatcttgtctttgaagcttcatagtttggctttttaatcaaatggttccttttccatatttaagtcatcactttacatttcattttctttttttttttttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttacatttcattttcttggagaggtcttcacatgactccaagctatcaccagttatgtgctatcgtagaacatggtttatccagaaatagtgataactttaatcactattgatcattctttggttttctttacatttattttatatcttaaacactgtaatataaaagacctcagggatggaccatgaatttcatatttagcacaatacttcagaagatccatcctatcctttttcttttttattcattttattttaaaattttcattttgaactactttaaagcttacaaaaatatattttaaaaaatcaagaattcctatatattcttcacccagcttcttgactgctaacaccatatctaagagtacagttactcacattaggaaattgatacggaattagttacttacctacagaccttatttacatattttgttcatggttccactaatgttttttaactaggatcaaaatcagggtcacatattgcatttatctgctacatttctttagttttctttattcgggtgcggaggctcatgcctgtaatcccagcactttgggaggccgaggcgggcggatcatgaggacaggagatggagaccatcctagctaaaacggtgaaaccccgtctctactaaaaatacaaaaaattagctggcgtggtggcgggcacctgtagtcccagctacttgggaggctgaggcaggaaaatggcgtgaacccaggaggcggagctttcagtgagcagagatcacgcctctgcactccagccttggcaacagtgcaagactccatctcaaaaaaaaaaaagttaaaaaagaaaattcagcttttctttttgtctttcatgcccttgatacttgttttttgtagattattttgaagtttgatttttttctaatatttcttcatggttaaattcacataatatattttggcaagaatgccacaatgccgaggttgtccttctcagtgcatcatatcaggaggcacatgatattatcgtgtcctaatattgttgacgttaactctgatcacttgaataagacattgtctgccacatttctccacttcaaagttaccatttttaaaatcagtattttgttgagagatacttggagattatgtaaatatcttgtttctcataattgtatccactaattttagcagacttgtctgcaacaattatgtggtatttgccaagaaatgagaatctatttccactattctttctatatttattgattagaattctactgtatggaaaagctttcctttgtcccacttttcttatttatccaattatttatttatattagtgtggattcatgtgtatttggtttaattaatctgaataatctattgccatcattatttattcccttgttcaatttatctcagtttgggtcactgagagccacttctagttagctcctatgttctttggcatgtctcaatcattagttgagacttccttattttcttaacaacaacagatgtctcagacccattttgttctttctgccgcatgcacctagaatcaggcattgatccaaggagctctgtatccttttaaagaagaaaaaagtgaatccaagatttgaatgctagatgtgctgattgctattaaaatgttattgcttctagtcttagtggttaaaattaagaaatatacacacattcggccgggcgctatggctcacacctgtaatcccagcactttggaaggctgagatgggcggattatgaggtcagaagatcaagaccatcctggctaacacggtgaaaccccgtctctattaaaaatacaaaaaaattagctgggcgtggtggcaggtgcctgtagtcccagctacttgggagactgaggcaggagaatggcatgaatccaggaggcagagcttgcagtgagccgacattgggccactgcactccaagctgggcgacagagaaagacttcatctcaaaaataaaaatatatatatatatacacattcacacacaaacatgtgcgtctaggtctatttatatatctacacattcttttcaatttctatctaacgtagaaaaaaagtaaacttaagtatatattgatagttttgattctgattgaacaccataagtgttattctagtctccactccccctcatttctaaattctttttctaaaacggaatcagttttgttttagttaatatacttaatataattatttgctttttattttttttttaaatttcaacttttagatttgaggatatatgtgagtgtttgttacagagtatactgcatgatgctgaggtttgggtatgactgaacccatcatccaggtagtgagcatagaacccaagaggtattttctatggcactttacacattctagaaaactggttgttaattagcacaagcacctataatagtgcctgatatatttagtactcaaaatatatgttaaattaaaaacaaatgtataaattaatggttgaatatcataataattactcaaaatgtaacataattccaaaggagaaaacttttttctaaaaaggctctctcaattgctctttctgatttactattttccccaatctgtagttgcttcattattgtttggaattttgcattagttgtcaataaacaaaaaatatggatcatatcacagctctttcattgctttcatttcttgagatatatgaatgtatgtgatatctttgatgtcctgtattttatctttattgctttttgttacttaagaacatctagaaaagaagataaatattaatcatgtcagaaattatcaaaggttgattacaataaaaatttctctaatgtgataaccactcaaaacttccttcttcatcaaaacacagtattttttaaaaaatggagtgctgcatttttatttcacagaaaataatcaaatgatagccagaatattttgaactagagtcacataggatattctaataatactgcttgtgaaagaagtattgaggaggtcttaggaccaaagaatatttgtttaatagtgtcagaattcattttaacaccataaaaaggatatgtatttgttcaattttcactcactgcacaaagaattagataaaagaagattttcagtaatagcattcattttgagtcttaccaatcctttcagttttggtataacaaaaatgctattagcttttactctgttgtgttgaattttgatgatttctgacagtcttcactgagatgctcaaagagatgagacttgccagtcgaaaaacttaagatctcattaaatttaccagcaacataaaagctatttctgcctcttaactttttgatgtgttgcctttttctagtcctcttctcaggacctatttaaaagacaataaaaattttgtttttgtgtgttgaaagatttctccattatcaagagagtagtccttaactttagaatgactgcatatatagatatgaaaaataaggaaacaattattaagaaaactaatcgaattttttactaatatttagtaattttaacaaaattattgtgcattgtattttgtagcatttatgcagaggatatactaacctgtttaaatttttagacaaaaatagtagaaaatagaacatcgtcattttcaggagcaaggaagtaacctgtgaaaaagtgaatgcctttcttcaaataatatgctaatgaaaggctgagatattaatgtctaaatattataaaactttcattttaatataatgttttactttatatttatattatattgtataacaaagaaatgtgagtcttgttacacctgagaacttgaactggcaatctacatattgttgttgaaacaattttaagttaaacatacaatgagagggaaaaatgattctgttgcctcaattttaaaaggaatattttgaagaaccaattttccatataatagcttgttatgatcttgccttttagcctccctggataaagaaatgcatacttataataattgaaggaagacaattttccttgttttctgcaaattagaaatatattaggctattaaatacataattcaaaatatacagaataaaggtattatagaacctaagaattatataaagaattatatacataaagtaatgaatacatatacaaatagtataaaaatactaaaaatagtatttgcttattgattaattactatgggtattatataactcttagtttctacattgcttttctattcttagttattataataggtatattataattactaatatgtataaactacttatagtttatatgaatgtgttatatgtacatgtatattataataactaatacctataaactatttacaattatatgtattataataactaataaatataaactacttattgtcaaaactgtttttaactattaaaagataaagcacacagatatgttttctttactaggtattcccagaagcactcataaaactcggggttttcatatagcagtgattacagacttgatatttttattattcccattttatagattaagagcacaagacccatattagtgttatttagccatgtcatagagccaattcccagatattttttccacttgttttgtcatgaagaatgagaagtagaatcagcatcaagtttgtgctaaacaagtacaataataagaagcacagcaaatgctgactagactgtaagaatatttttgcttttaggccacccgaaaaagataagatatatgaggtgatcaaagtgaataattatataaacaagaggaattagaatatgaataagccaggaaaaataggaataggccaagaaaacacacacacccatttcttatttaaacctaaagggagacaaattcattcaatctatacatatttattttgctacctcaatagagataaatatcttctctaagaaaaatcccactttacttaatatgtatcacatttacctaataaataacacattactaaaacagagagcaaccagtgttttactcttttttttttcagagatgttttgctcttgttgcccaagttggagtgcaatggcatgatcccaactcactgcaacctccacctcccaggttcaagcaattctcctgcctcagcctgccaagcagctgggcttacaggcatgcaccaacatgcctggctaatttttgtggttttttttagtagacacgggatttcaccatgtcggtcaggctagtctcgaacacctgacctcaagtgatccacccgcctcggcctcccaaagtgctgggattataggcatgagcctttgcgcctgacctcatttattttcatataaaatatagggtcaagtatgttgagatattagttacgttatattttgctcagtattgcctgagagttggattattttatcattgtagagaatagcttctagattatgagaatattaaataaaataaactggagagactctcagcagcaaactatggtatgtaagtacatatgtaaatatgtatctatctatctatctatctaatctatcctatctatctatctatcatctatctatccatctatctatctatctccttttctttcatttatgtctggatctgtaccaaacaccaggcagaggagttaggagaagtaactgaaaaacccatgggtgacatcaccaactaaaacaggtgacaaataatcagcatgaaacccagaatacaagagtaattgtcctaatcactggcagcatagggccagtaccagctggagttaatggcaaagataaaatgaagataaaaggaagtattgtaagatcttaatatcaataaactacaacaagaaatcatcaataatgctcactcgcaaaagaaaaatacttaccctgaagaaaaacaattggaacaaaatcaaaattaatcagagaatcagataatctgagacaagtaagataatttttagaaaataatttttagaaaaaaataatttgaaggtacataaaatcaaatagaagtggtacaaactatagtaagagatatagagtataaaaataagagtaaaaaacagaaattgagagattaaaaacatctaaaaattttctaaacataaaacttaggcaaagaatagtaatacccgtgtaatggttatttctaagaacaaaaattaaaataaaaaataatattaattatttgagcatgaaggtaaaaggataagaagtttatattgataatagacttcttgatagcaatattttatacaggatgataatcaagaaatggtttaatgattatgaaacagataacacagtagcgagatgagattttattcatccaaactatgaatcatgtctaaggaatgtagaacatcatgaatatttatgattttaaaaaacattgttcctgtgatggcttttttagaaatgtcctacctactgacaagaagacaaacatcatgtgaagcttctggataaggactaaatatgtttaattttataattaagagcaagtaatggggattaaagtgacaaaacatgatgctattaagtgtgttaaacatgaagaaataatgcaactcaacaacaaacagaaaaaaggagaagaaaaagaaagtagacgaatcttaatgactatctcgggagtatctaactgccattaaaaaatatggaattaaagtaaataaatgttaagccaaaagagagaagaaaggaaagagagtttactagagaacagtattactactcattgaagaaaacaatagatagtattcaaacacactagaggactagtatattttattataatattattataagataataataagaataaacatagaaacatttataaataccagatgagtatatcctgcgcctcaaattaaagtgtaaatacagggcaagattttatataaattatttatatagcaaaaacttatataacagaacttaacaccagcataacaggtatatcaaagacacaaatgggcttaactcaccattaaatggcgtacttttagattggctaatggagcagaatccaatctattctgtgtgcaagaaacatattgaacaaggcaattcagaatggtttaatgtaaaaggaagagcaaagatagatcttgtatgatagcaagatcctgaaatagttgtcagaattttgctatgagacaagatagaatttaagacaaaataaatttaacaggataaggaagggaaatttattctacagaaggattcatgcttcattctacattaaaaataaaatatatattaataacatacacaaaattacaattttcataaagcagaaataacagaagttgaaggaagaaatagacattacaactggagattttaacatagcttattaattggtaagtccttgaagaatgcaaataagcctcacttttagtaattaaaaaaaattaacacaaatactgacaaagactctctccttcatcaaactttagtcagatttttgagctctcctctcaactagatcttcatctaggccccttgcctagtctccatagctcacttttaacaagaatccttaagtccatatagagagaatcttgatatctgatcaccctgagctgccttcagcaagaatcctgttaatttggtttagcaagagttcccctacttttgacgtctcctcttaataattttccatccactgaccccttcacactgctcctttgctacaaatttccatgtgtgcttgtatttggaattgagctcatttctctactaaagtctcttttcctgttttgcagtaatttctgaataaaatcttctttactgctttaattatcctctggctctggttctccttgacattactctttgaagaatcactttaggggaaaagaataaatgcaaaaagacaaagtcagagactattatccgaatatagaatggagataatgatatcatactgaatgggcaaaaactggaagcattccctttgaaaacaggcacaagacagggatgccctctctcaccactcatattcaacatagcgttggaagttctggccagggtaattaggcaggggaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacagacagagagccaaatcatgagtgaactcccgttcacaattgcttcaaagagaataaaatacccaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactacccaaggtaatttacagattcaatgccatccccatcaagctaccaatgactttcttcacacaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagatatatagatcaatggaacagaacagagccctcagaaataacgccgcatatctacaactatctgatctttgacaaacctgagaaaaacaagcattggggaaaggattccctatttaataaatggtactgggaaaactggctagccatatgtagagagctgaaactggatctcttctttacaccttatacaaaaattaaatcaagatggattaaagacttaaacgttagacctaaaaccataaaaaccgtagaagaaaacctaggcattaccattcaggacataggcatgggcaaggacttcatgtgtaaaacaccaaaagcaatggcaacaaaatccaaaattgacaaatgggatctaattaaactaaggagcttctgcacagcaaaagaaactaccatcagagtgaacaggcaacctacagaatgggagaaaattttcgcaacctactcatctgtcaaagggccaatatccagaatctacagtgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagccaggaaacaacaggtgctggagaggatgtggagaaatagggacacttttacactgctggtgggactgtcaactagttcaaccattgtggaagtcagtgtggcgattcctcagggatctagaactagaaataccatttgacccagccatcccattactgggtatatacccaaagaactataaatcatgctgctatgaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagtaaactatcgcaagaacaaaaaaccaaacaccgcatattctcacttatacgtgggaattgaacaatgagaacacatggacacaggaaggggaacatcacactctggggactgttgtggggtggggggaggggggagggatagctttaggagatacacctaatgctaattgatgagttaatgggtgcagcacaccagcatggcacatgtatacatatgtaactaacctgtacattgtgcacatgtaccctaaaacttaaagtataataataataaaaaaaaaggaatggagataatgatgacgatgatgtcttggatagtgattgcaatggactgcatggctgttgccaccctgtctctgaaacttataggtggaaatcctaacccttaatatgatggtattaggaggtgggactttcaggaggtggttacatcatgaggttggagcccttctaaatggaactagttcccctatataatagacccaagagagttctctcactctctgacatgtgaggatacaagaagaaaatggtagtctgcaacttagaagagagatatcactgaaacctggtcactctggtaccatggtctcagacttctagcctttagaactgtgaaaaaattgatatttgttatttctaagccacctagtctataggtctttgtgatagcagtcagaattgactaaaacagtaatagtagcaatggcaatggaaagagtgaatgcatttgatatatactttgaagaaagaaataacaggactatcagtcatgtggacgtttggcatgagagaaatgcaagatggtagttaaacaaatttgtgtctaagtctgaaggttgaagaatagtcaaaggtaaaagtaaagctatgggagttaccgacacttatgagccttttaaaggaattatttatttttattgttaaatcaccaaggaagggttgaaacagacaatagaaattaatgccaaatgagctgaaaaaaaaatgtattgcaattgagttgggaataaaaagctgaggtggcaagaagaaaagcaaggttggcatatttttaacgaactctataatgaataatgttttgaagaggaagaaattttcaacaatttgaaatgctgctgagactttgggaaatgtgaatggtgcccatgtagaagttattgacagtcattgaaacaacactccctttagcattatgtataagaaactagattagaatgaaacaaatggattcttaattccagaattgtggagaaatagaaaatctaaaaacgtattggaaacacaagaaatgcaacatgaactataataaccatccatttcaataaaattagaggatttcaggttcagtccatgataaagtagcacaaactcacaccctgaagttggctagaaaagctgggcaaaatatgttagacaactgttggaagacaccggagaacaatcaatgtatacagagcttgagtgggatcattattaaaaagaaataattatagactataaattacattcactcagatgtttttcctctaataacatttcccaaatactgatgtgaagaaagaaagcatacacggaaagtgaaattttactgtgttgaggtgacagagattagagttcagagtatctagtgtgtatggggctcacgagacaaatttccaagaaggaggtaaccacagagagagagcctgaatatctgcatacaaatgccccttaagtgtggccagtatcaaagatatgtatgcacaaggtgagacgtcaagaagcctagcagaaatcaataaatgggaggttggagtgctgagtttagatttcagctagtggtttagagaagaaagaggctgtggttcaaacactggtaattatagaggatgagatgggagtgagaaactatatggctaaatgtggtcattcttcaggttttagtttttatgcagggtgctatatgctggttgcttctaacactgtaaaagttattatttaattacctacatataaaagatgaccatgaataggcataagatgaaagtatgtcattaatcaaaatgatgattaattcaattctctataattgtgattcaattaaaaagaatattattcatcacattcacagagtaaatgagaaaaatcacataatttcagtagatgcagatacataagatctgtatcctaacagatattgatacaaagaagtatttgataaaatttatcattaatttactgtatatctatatgctcttattaaactaggatttaaaaggcacttcattaagttgataaagtgtatcttttgaaatcctataaacaatatcttatgacataataatgtgggaatgttagaaggcttgcttttaaacctgggaacaagaagagattctctattattttcctatgctgctgtaacaaattgccacaaaatgggtagcttaaagcaacacagactttttctcttatagttctgaaggtcaaaaattcataaacagtatcagtggtctaaaaccaaggtgtgatcagcaccctattttttccagagaactcaggggagagtaattctagaaattattccagaaacgcagcttctagaactacatttcttgtctcaaaggccccttcttctatcttcaaagatagcagcgtataattttcaaatatttctccacttccatgatcacataacctagattctatgtcaaatctccctctccatcactcttataaggacacttaagattgcatttagagcccaccaagataattcatgataatcttccatcacaaaattcttcacttattcacatctgcaagtctctttgccataaaggttacatttacaggtactaaggattaagacctgacatctcttgaggccattattcagcctaacacagatgtcctctcttgctgcttgttttacacattgtacttttcttaatacttttgagaaagtttgctctaaagaagaaaaaaaagtagttctatatttgtgagacgtagactgaggagaatgactatttttctaatgtgatatataaaagcacatttatgtgacaatagcaataatagagaagataaatgaaagttatgcagaagggagaagatttgacaatagcaagcatgaaagtcctgcaggagaaaagtttggatgggatactgaataaaattgtaatattactttttgatgcatacgttcacaccattttttcacaatgcttcctagatttctctgtatttctttcccatctatatatatatatacacatatatgcatatatatatacacacacatatatatacacacatatatacacacatatatatatacacatatatacacatatatacacacatatatatacacacatatatatacacacacacatatatatacacacacatatatacacacatatatatatacacacactatatatatacacacacacacacatatatatatatatatacacacattttgactgaaaatgattgactgggatgaaagaaaatgagaaagaaaaacggaacaaggaattctcaattatataaatagaatattataattagtaaaccatgaataaaagaaggcatatgggctaggcgcggtggctcacgcctctaatcccagcactttgggaggccgaggtgggcggttatgaagtcaggagatcgagaccattctggctaacagggtgaaaccccgtctctactaaaaataggaaaaattagtcaggcgtggtgatgggcacctgtagtgccagctagtctggaggaggctgaggcaggagaatggcgtgaacccaggaggcagagcttgcagtgagccgagatcgcgccactgcactccagcctgggcgacagagtgagattccatctcagaaaaaagaaaaaaaaaaaaggaatacttgataaaaaaggtatccatatatcagatatgaagatgtaaaatttatgtgctatctacttctggaatttccaccataagggaataataatgatgtaggggttcacttgaaggacagaacttgtacttggttacttatgtacacaatctctgccttactcgcttttggtagatcgtattgtgtcatttcaatgtggccattattgtcttttatgaacatatacaacaaagtaatatacctttacataatgtctacatctctactgtaatttaaaatttaatggctcaaaaatgctaaattacaaaatagaggaagatgtgtgttaaatgcagattaatataatttaaataatattatatatgataagggtttgtaaaacttaaccattaagatggatagatgagaaagatagaaacctagaatacaatactagaaaatctagaaacatagtagagatgagttcaataattcgattctatataagaggtcatcaaactacaaagcacagagctaatcaggccactgatacattttggtaaacaaagttttattagaataaagtgacatccttttattttacatattgtttacggctacttatgcactacgatggcaaatattggtactcgtgacagagatcacatggcacgtacattctaaaatacttaatagttggcccttcacgaaaggttttgagagctactgctctaggaaatctcaggttcaatgtcagttatgaatcagcgttgcttagcatagccatgtttgaaatcctttccaatgacaataattgttactgcctctagacagaagagtccaattattttaaggtttcattattaggaatggttcatttaattaagccatagttgttacttcaagtataattaattagtgaagctatattgcttttatgggatataattaataggaaaataggttactgctctgtggcatagttataatttaaatgctgtggctttatagaatttaaaggtagggtctgtttattatgaattatgcctcccatcatctagctcatgtgaggtagttctggaatagcacattatttatgtttgctgataatttattttagatataatggttggttaggaaggagttcatggtgaagaaggtagatgtcacaaaaacatgcctgaaatggtgatggagaagatgaatccgtgtatttattcatttaataaattatgttgtcattcaagcaaatacaaatagtctttactctgaacattcatataaaatatctgttgtataattaatcgtgtgcttctgaataaaatggatgaaagcatagtttgcattataagcattaattcattaaaatttaccctgaacattgttatttggttttattagcaagaaatatagcacttggaatggtttactaaatacatgtgaagaactctagatcataaagaacctaaaatacagaattttcagcattattataatctatttaattacacattcaggtttatttgttactgaaacttagtaacttgattttgggagttttatatcgcttctgtgtcttgtttgtttgcacaagtttgtttatggtgaagtgcaaagtattttagtaaaagggatttgagccacagatgacaaataattacaggaacatataacataaactacacttggactttaaagcaggtttagattatattactttggttattattctttgttttcaaaagggaatgatgggttatagctatatgcctaaatatttaggcaaaacacgacaaaagaagggtgaagagaccttttatctaatggccaaagtagaaggtagcactcataaaatatactgttttgtgtaataagtgaatggaatctttacacaattttttgctagggttgtttaggaaacttttctaattggcaactacttcatagaaaaacttgatccagacctatatgtggaacttccctttatattaacttgctgaaattattaaagttaagagcttgtttttccaggttgatactctcaagacctacaaagaccagcacattgaagcaatcagttgattaccgtcgtgatgcctgcgtatgtttatttcatgtcagacacacctgaggtctgtaattgaatacataaagagtgcaaccatggaagaaacaaggttggcttgtggtgttcctatggcagcatcgacacagcttcaagtgcaccatgagcatgagcactgccaagaaaatatattggctctcaactctcagaatactgccgcgtctagaacttttggccttgccaaccactgggcagtaagagacagtaacaaatcacagcagatactgtttccttagagcaattaaattacatcagaaaaactaagctgagtgataacaaaacaatttctaaatgtcaggagcctgtatcaattcattcataagttgctcatttcacatgtccttggtgttgcttatgattctactcatgggtcattgtcacctttataccaggatctagaggacaaagcagccactccagaacattgaaagttactgtagtcaaggaaaaaaagaatgttgtgaggcacgctctgaatttttgcctctagaaggaaacagacactttagtctactaacatttcaataagcaaaaggaaatcacattccataactgaattaaacagggcagtgagctatatcctaccatgtgtatgaagaagccaaaaaatatgtaagcaatcctaatgtttatcaccttaaatttatccatgcatgccactgtggtcactttcactgtaaaagcagtcattgcagaatcatcactagtatctcagtgtattagtcagggcaattaatattagtttctgaaccaaactgcaaatatctgtgacttaacacaattttttttcttctcattcatataataattcagtagaggattaactttctgaaattccttaaaggttttcactgaatcccctgcatttaatataaagaggagtatgagaagcattgcgtgaggtatcttatagctcagtctaaaagtgggaaatataacttttacctacatttcattcaccagtgaaatggtctcatcctacctgcaattgaggctgaaaaatacagcatttccttgtggtccaaagaaggaaataatgttatctcaccaatctctgtcaaggtcagtccttctgatgccaaaatacctgctttaatcttcctcccattataaaacacactgacttctctcaaaatgaaaaatgcagagttctttcaaggtctggcatccagctcaaaatgtagtatctctggccactcataattctcccagtgaggtccagataaggtcctcatttctcagtaaaatctaaacttaaaagaataaatatgtgtcctgtgtacaaatatgcaacggtgaagtgggaacaaggtggcagcaataaatacatctctatcaccacagtcatttgttcttgactatttgcaaatcatttcaggaagacatggtgaaacatcctacactgtgagtggcagaaccccatgtgcactgcaatctcatttcctaccctccggaggagtatataaacttttcctacgtaaataatggccacatttttgtatcgatacattgtaagttctaagatgtgtgtgtttttttaagaggaattaaaatagaaaagcatatacctgaaagatgttcctcgggatatatctgcatatattctctactcttgtcattttaaataaaaatacagtggtcccttgatatcctcaaaagattgggtccaggaccccagaggataccaaagtcagcacatattcaagtaatcctgtggaaccagagtatacaaaaagtcagtcctccatatctgcgggtttttcatcctgtggctactgtattttgatccacatttcaatgcagatgctgatttttttaattaaaagaatctctatataaggggatgcacacagctcaagctcatgttgttcgtcaaccgtacttttttatttctgtccaatataatttaaataacataattctgtgaactgcatgtcattaattacatatactaagaggtggcataccaatgtgtttaaattccaagaaatggtggctagcaaatttaattctcatctctgctctgccacagacaagttctgaagtcttgagcaaatcatgagtatctgtctctagcttactcaccttaagaaggagccagtaagtagcaattatctttcagtgttcttatgaggagtaaataacctgtacacatcaatgcttagaacagagattgccatgtggtattatgtccagagttggttcctgcaggtgggtttggtgggttcgtggtcttgctgacttcaagaatggagtcacggacctttgccgtgttacagatcttaaagattgcatggacccaacgagtgagcggtagcaaggtttattgtgaagagcaaaaggacaaagcttccacagcatagaaggggacaccagcaggttgctgctgctggctggggtggccagcttttattcacgtattggcccctcccatgttccatttttgtcctaccagagtgccctttttttcaatcctccctgcaattggctacttttaggatcctgctgattggtgctttttacagagcgctgattggtgcattttacagagcgctgattggtgcattttacaaacctcttgctagacaaaaaggttctccaagtctccactccacctaggaagtccagctggcttcacctctcagtatgttctgaataaactgggctattaaatatgtgatataaattaatcaagcagagaaaaagttactagtgacagggaaaaggagaaaatatgtattcaatattattttgtaaacaatttataaatatgcttcacctatgagtttcttctcagtaccttagaaactataacaccatggaaaattttggatagtttagggaagtgcattatttggtaatgtgaaaaataagatggtcgtgataaagcaacttgggaaaaaagaaagggcatgaatcttgagaacacgtactttctgagaattttcatgtttagaaaagagcaagctaaaaatctggaagcgtgttttttcacaggcaattttcaattggcctcatgcatttctgtgcatcttgcaaatagaaaggcactagcttcacatttattacaggttttcctttttaaagatctttatatagtggatagccctggaagatcaagatattgtttatttatggatgagagaacagatttattttcaagtaaaatgaagatagtgtttcctccacagaaaacatcagacaagtgtgcttactgctcatttattaaagatttaagtttcctttacttggagttcttcatctgtgacacaaactgtgtgtagcatcaacttgaactccttgtcatcatctccagtaaacttgagggaaaacaggaaccagagcaaagatgaagctcgtgcaactctgtgctgtgctgcaaataatggaagtctttctgtctctgaccaaagagttatgtgtcttctgccagcatccataaaactgaagcaggctaacttgtaagctcagatccttcacagttcttgacaatagtcccttaaaactgtctgcagatgcacatcccttggaaaaattttgcatccttttaagaataattaatatcctagttaatgacaactatatgacaggatagatcactttaagcttctacccagattactataacttttaggtaaataatgtatatgccactttttctaaggttatctagccattttcgatgtagaaaacaatattgtgtaagataagctgagcgtatttttcacttcgtttttgttttgcaaaacaattttactggttttgttaatgccccaatcatcagtactgcttggtataagagccgagtttgaagaattatcatgttgcaaatgtattttgctcatttatttcaaattagtagacagaattgagaggtggaaaattttagaaaaatcttggttaatcatacttggaatttggttatgtaatatctctttctcttttggggaatacaaaggttcataaactagtgataatcttcactcttggaaccattagatgctatcatgaggttagcacagaagataaatttataatgttgcagtgaggtaaggaaataaaacatgtaagtctttgaaaacaacactatgagagaccttgcaggctaaaaattagacaccaaagcattttttgttacttttggagaataaaagaagtgtgcccctcaatgtcttgtgggagaaaatatatagtttgatacacttgtcaatatctctaactcaaaaatgatgagtataacgagtgacccttattgtagtcttatatttctctccaacaattaagagagttggtggggatgttttttccatgagttcatcctgggccccaggagattttcatcttgtattctctttataatcctatcttagtgtttcatcctcatggctaagttcagcaatacttcacagtaaaatgtgtaagaagagatgtaaaaacaatcggctttgtctttatggagattaacttaaatttatgctcataatataattcatattatacttgatcaaaattaatcactgataagagactatagaaggtaatctcctgcttgtggtcataagtacttaggattctattactaaacaaaatgaaagaatgcattatatggacaattagtggtctctagtacaaagaaattaccaggtcatttccaattctcaatattaaaaaaaagtttatttcttactgcactatcaaattggaaaggtcagtacaggggcattcaataacagtaaaaatatgaataacaatcatatgtataacaacagaatcatttaaaaagatgtatatttaaaatgtgattattgcattttatttcccctggcagaaaataataaactggagaaaaatcacatttgattgatgtctgttacatggatttttaaaatttgtatcaatgaatgctttttaaaggtaaactaattgaggcctaccaaagataaataaatcttaattattttggtaaatatattttacagtttcattctttttcaacttaagttagataatatgtactatattctctcctaatataaatgtttatgagcattgaaactccatctggagaaaatagaaacacttttaatttaaatgacgtttgaagaaggaaatgtataaatgtattcaaaactgtaagtgaaaatgggaaggtcctattaaaaaaaaaagaaaggataaacagtttccaatgacttttctataatattagcaaatttattatgatctgttatgaaagactgttttgccttccttgtttctactgtctcaactccctaagtactaattcaattgaaaagttacttcaggtatgggtccattttaatgtccctctacaagatctgcagtgccattaattataatcatataatcttagagccaaaagggcccttagagattatctaatcctattctattaatgcatgatgaaatgggcttagcaatctgtctaaggttacacaaattcaaaaacacatagaaagttttcataatcaaattaaattaaaagtacaaaacaatgtcactaatttatgtataagaaaatattaaatatcattttatatgaagtgattctgataattttaatgagttcataacaatgcttctaaatatttcaaaattttagtttatcatccaaatataataatatacacttttataagtgagtcttctacagtgaaaattactaattataggaaagagaaaatcatagataaatagggttgtatcaaactcttaaaatgtacatgtggaaatttaaaaatatcctcttgacaaggggatgttgatgtcattccataacaggattgacatgtgtaattaaaacaaacaacaaaaattaagaatatataaataatatttaaatgcttgaatttgttatttataatgaatattgaaatttatttagtgagataaaaggttaacaaattcttgaatataattatactacttttataataaaatgcatccaagctgaaatctcacttctgttgtcaactgctttgatggttctagactcatttccctatttttggtgagtcataagatggatgacacacatgctcaatagcaggttattttcatggctaaggtttatcatagcaaaaactacagagcaaaaccagttctactcatatttttaatgaataataagctaatgatatcttgttattcctatgctttgtctatcatacctacacataaatataagcactggtaagttctggttccaaacatagcttatatatgaatgccataatcattcaacatgcatacattagccttgaattttgaagattaaaaagtgtttgtaaaactacctagaaaaaatttattatgattacagccactattagatttcaaaagggttcatcagaaatctctgaggtatatgatggggaaagaatattttgactaccactttaacaggtctgctatttaataatattagtttctttttaattgatgtttcatggacatccagaatactagctataaaatcatatatgctgcataatgcaagcaaaacaaaagcacctgtaaatattacagaagactatacatgtatgtatatcattgccataaaatacctatatacatatacgtatatacacacataattgttttcacaaccatgatagtattacttacaaaagcatgcaaatttagggagatggctaaataagttatggctttttcataaattgtaagcctattcattataaaatattattgaggatcaactttcatttgttccccaacaaattattgagcatctactatgcatattctaggcccatttgtagggactggggaaaaaatagtgaaaataacattcagaatgtcttggcttcacagagctgttgttccagtgttgggagaaaaacagtaattaataccacaaagtatcatgtgttgtatgccagatggtttaagttctattctaaaaaatgtggcaaagaaggggaatagagagttctgggcacaagaggtgctggatactgaacaagatggttgccgaaagcctcactgggtggtatcatctgaatacaatgagtggttatgagagaatgagccaagagcataattgagagaacatattttcagggagcagaaatagcaaatgaggccttggtgtatgaacgcacccgtgaggttccactaaggatgccaatgtgatacagcagaggagatgagatcacactccatggggagatggtcacataaagcttcttagaaaatggtaagaacttttgtttatttaattggcagccatgaagtattttaaacagaaaagcaatcgcctctttaaagaattagcagtaacagtttgactgatctgtgaaaatagaccatagcatagcaaaagagaaaacagggaaattagtgaggaaactatcgtgtaaactattcctgaagctgttgtaaactataaactatgtaaattataaattgaaattgttctatgcaaacaagatatatttgaaccctgtatattagaggcaaaagtccataatattggcaatgttttggcctgaactatgggaggaacagagttggaattactcacctgggtttaaatttgggaggagcaaatttgggattagaggataggaaagatcaatagttttatttttaacaggcttaattttaaatagacacttaatcatataatatattttaaataaattattaatcataaaataatgtcaggctaattctaatactcacctatcaattataaatatattctgttttttaaataataaatcttattaattttataattatcaaagatgctataaaaagaaatattttttattactatgctactgatgtatttccattgcattgactaacaaaattaatactagaattttcaaaagtatccacagtggttactttatttgcactgttaattcagctctttttaagtataccttctagttccctaattgatataattcagagactacacttggacacaatttaatgaataagcaaattaggtccagttattccaatatgaaattccttttaattatgggctacttttggagatgtagaataatttgaatgtttaatttggtgattcagtatgacctacttcacattgttttatgagtgggtgaaaaatataagtgctaggaaatgtgtaccagaaataatttgtcatctaattacatttcagaacattatacctcctcaaaactttgtttcagcatatatctcattttaaaaatctatgttgtatatatgtttacttctttaaaattttaaaaatgtttgtggcattcacataaaatacagaagagaatagcaataagtgacatacatatacttcaggacctgaacatttatatgactacatttttttctttccttaaaaagaatatattcaaatacatcatgagaaaaatgtatagctttatagttaggataaacctttaattcaagtgctgttacttgaattaaggatgcacaagccccggactctactccacaaaccccacctgctattctcaccacataaatacctagggagagggatctgtctgaaggaacctttcccacaacagcctttattcaaaatgacacacctgccactttcctgatgcctactcttgtactccaactgcagagtgatttattacacacagtttgcttgtatgttatataacagtgattacatcaaggatttgggtactagctaactgaattgatatatttgaaagtactttataaaacagaaagtgctgaacaaccattaagtatacagaatgatttggcaacaatcatatgtagtaccatattttctgaaatatctatttcttaaaaaacaagtttcattaagtgtattatttgctgaataatctctcaaaagtcatgttttcatatagctactattattgcattttgaaatcaaacattattttctttgccatttcagagaagcccttggtaatccagcccgcaaatgcaattcatgcgcatggctctaaagagaaatgggcaaacaaaaagaagtttaactacacattcaataatcatttatttattttcttagagatatctacagtagctctctcttatccttattttaataaatgctgacgtatagaattagtgagatttttggtaataatatttttttttgaggcagagtcttgctctgccaaccaggttgaagtgcagtggtacaatctccactccctgcaacctccacctcctgggtttaagcgattctcctgcttcagcctcctgagtagctgacaggtgcgcaccaccacgacctggctaattttttgcatttttagtagagatggagtttcaccatgttggccaggctggtctcactcctgacctcaagtgatctgcctgcctcggcctcccagagtgctgggattacaggcatgagccaccgcgcccacccgggttataaatttgttattcctcctgtggttgtttggatgtgtatttgtgtgtgtgtgcacatatacatattattgaatttacgacgttactccaaaggcttttctttaactattttgcttgatgtatattcaacaatgatagtctcaaacaaacaaacaaaaaacagaccacacatctgatttttcaccaatactgtttatagaatgaacctgtatagagtctgaggctattctgatgataaattgactataggactagaaaaaactattttgccattttacaaacgctcattatgcaccttatataatagtgccaagttaataaatttgcttctatgtttatagtctgcaacggaaaaaacttacgaggtactattttccagatgaaagtgaaagtgatgacagattttatttcttcacttaaattattaagatatacctttattatgtgagcataatcgattttattgcagggaagtcccttaattcagtaaaaaagacaggattgcttcttgaatattaaaacattttcatcttttcagttttgcttttcttgattatctatttttctttttactgagtagtgtatatcattttttaattaaatataatttaaataatattttacaataatctaaaatgcttctgaatacttcgtcaataacttttggatgttcaataacattaagaacgattacatttttcaaatattatttttgcattatttatatgtttgcatttttacaagtgttctaatcgcatattgcaaggccaaatcagaatttttaaagactttattttattaacatttaattatagcaacaattaagaaataaaacaaaatgacataaaattttaaatcatatgaataaattaaacctatatatttaaattactttacaattttagtatttttcataaatgtacagaaatttcattttgtgtctgttgttattacaatattaaaattatgtaatggaaaaataaattaagcatcaattaagacagcatacatctgttgacaaaagaaagagaaggtatatttgatttccttgattttttcctctcaaaattgagaaatagtttaattttataaatctatatccatttaaattacttaagtcaccattttagcctaattttttcattttctagatagattactcttttttttttttttttaaaggtatcatttattctggttacgggtaaaagacaactttagatgtgcaaatatttagatatataatcacaattagtatttttacttcatgaaatctttaggcgcaaactttgctgttctaaactaaaatttggattccaattcaaaagctaaagactatcatagtgtgattatcccaaatgaactcttttacctaacacttactgaaatttcaagataagtagtattgagattctacaagtcagtaagaggtcttctccctgtgaacttttaggttttaagggcacaaggaatttaatggctactgggctaaagaatgtaataaccactattgtgcatatgattttagtcatataggcaaaaagcctaggagttacattgtttggtcagatggcataagtacaattaattgcaatataaattgtcagattgtttcaaaaagctctacaataaattattcttcaccagaaatatatgagagaacactagaaacaataagtcctatagatatctttaaatgctacctatttgatggtttttctggtgacattcctgtgttattttaatttgtattttctttaccacccatgaatcttaacagatttttctatgaaagttcagcactttgattcattcttctgtggactgactgcctgtgcctatccacttccctggctctcttgcttggtgtgtgcatgtggcttagttttagcaaatagaatatttgctgtccctgagccttagtcttaaatccttatacaagcactttttcttgttatcttacctgtttgtctgacttgggtgatgattcttagagtaattttggttgccaaatgttaaagttagtagaactactataagcctctgagtggctaaatggtagttatttctgtggcctgaatactcttatgagatattcagagagattgagagggaagaattatttttgaagacatggaatttttattttctattccttagaacagtttagtttaccctaaatagtaactacctattattttcctctgctaatttttcttgaggctcctaactttatcaggtgaattttaagacatctgtgaggctgggcacggtggctcacacctgtaatcccagcactttgggaggctgaggcaggcggatcacgaggccaggagttcaagaccagcctggccaacatggtgaaacctcgtctctactaaaaagaaaaaaaaatagctaagtgtggtggcggtcgcctgcagttccaactactcgggaggttgaggcaggagaattgtctgaacccgggaggtggaggttgcagtgagccgagatcgtgccactgcataccagcctgggtgacaggcaagactatatctcaaaataaatacatacatacatacatacatacatacatacaaacacatatatgtaatgtataaatattacctttttgtcatctatttaacaaaatatttgctcaaatatatccttccatctgacaactatttaacattacttttctaatatttttaccttattgctgctgacttgatacatttttattcattccactacatccttgttattttggaagatctatcctttatttctttattaaggggtatcttcaattttttgacctcacaattagatgcataattttcaagtactatttgaaataaagatgccttctattgtcttagcaaattagtcaatttctctacttacccctcctcaataagttgacaaattcaaaaaacataaatttccccatttctttttcaccactcccctccaagaaaccttggaaccagtttgttccaaggtttgttcccaccaaagtctagattatacaaaaatattttagaatgttaacgatatattgttagtaaaattcttctattgaatagtttatgataatttgtcaacatgaaatgttaggcagacattgaataccaactagagctattcatattctcttaacgggatttccattgagttattgatgaaagataaagtgatataaagaaaatgtgtatacaccgagtgcaaaatattttataccctttatgtggccatgaatattaaatcacagttatgggaggaaattgccaaatacatatattaggctgttaaaaactgtttttctgagctctggaaactgatggataggcatagcagaagagagcagaagcaagccaagaaatcaaggaaaggatacagctatataacaagaaataaaataaaagtacgtaatgtaattcccttagaaaatgaagtagggtgactgagaagatgtggagaacctttataccaatttcctttttctaatcagatttgattataaaacatcgacataaaatcaatatatgtgcattatattcatttcaattttaacttcaagacctaattttgctgtcttaaagatcatggataactccatcttaactcagtgttcaatctataattcattaaaacagttttcaaaagaattttcaaaatactttattatgattacaaccatacttaatcttcaattaggacatactatgtgataaatactatggtgaagtacttctcaataatccatattcttaaacacaacaagttctaggatcaaactgcttaaatttatatatttgctcaatcatttgcaacataaatattttacagatgaagaaactaaaacacttttttttttctccgaaactgtttcagggctaactaacttactcatgagcttggtaaaaataaaaattattagataccttgtggatccgttgcatatatttcaaatttaagtttttgaagcactttttgaaaagacttctttatgtgacatttgttcattaaaaacacagtgattcttttttgaaatacgatccaattgtaaaatatcctgtgtctagaaatgaatttattttcctaacaaaaatgaattaaattaattaattaattaaattctcagaaccattatttaaaccaagtgtgttgatcctacaaccagtgaaaataatccctacaatgctaaaaatgtgtgtgctattatccatctatttcctagttcattaaagccaagttatcataatctggactttttaccaaagattttcagggatgtcaaaggtttttactcctaaatttaatatgctgaaatattactttatgttctatttatttttattcatttaaaataacatttttctctatgttgcgattgcaaaaattaacttatttacatatatacatgatgtcatgatatactctaggcacaattttggatatttccttttcccaatctgtttaacttacacaggtaatcaatatatgtaatcaccaagcaaaagaccttccttggtttctattttgttattttttcctctggaaaagagtttaagatagttttaacatgaagaatagcaaccatattttttgcatactgttatttcttcaaagacgcttaatctatataaacaaattttaaaaaccctggtatcagttaggtaaaatctctgagatttaaaatatttactaagctactaaatgttaagcaacacgggattttgagagattggccaatggcaaggattgtaagggaacaaaaacttggaaacaatgctgtttgtcgacatcttgaataatttgctgtgcctctattttatgtcacggtatttccacttccaggcctatacaaataaataaaatcagtgttatacacagaataggtacacacacacacacaagcgttcagatataaagatttcaactgtagcatcatttgtaataaacaatattggaaacaatgttggtatatattgctaagaaaatgtgttgagatcaatttagtataattatataatgagatatatgattatttcatttctttatggaatgagtgtaatgggaaaatccagtggaaagcttacgttaaagctaagaaagttaaatctttaagacctttcatgtgtatgggtctttctcggggtcatatgagttttgcaaaatttgctatgtaagatgcttaattaaaaataagaaaagccacacctgttttgactcccatttgcctttagtcatttatctccctgtcaggtagtgcgggtccagcctacagcacttttagtattcagctaaggggaagttgaagagagacatatttaatttcagttcattgaggttaatgtgcttgatttaaagccacttccatgtaaaatgaatttgtttctggcagttcagagactttctattgctcactccatagattcatccagtgtcgtagcacagaggtgcagaggcaggaatgttgtgagacacatgtcatgcagtacttggtaccagaggctgcagagaaggaaagaaacagctgcccttaacctagctctcctttccactaattcttaccgtggtggtgatgtggtgagaaccagatgtcctacatgtaaggggatctgctgtaggcaaagaactctggaaaaaagaacctgagcatttttgtggaagagtgacccagttgctctgacccccttctgagtgcgtctccatagtcacaaaatggaaaaaaatctgagttcttactctaaccatttggataaaaataaatcactctaggggaaagataacactagagtctccagctttgtaacttctgggatgcatctactgggtctcatcttctcttgaaatgtaaatatatatccctagtgaggtaaatccctcaggatggcccctaaccatgttctttctgtgaattaatttccagagctagttcttagcgtagagcagaagtctgagtaaaatttgttgagaaagttcttactatgcataaataactttatttacagcctaacactatccattaaaatcaataagagaaagacaaactaatccaaaatgaccctgcaatcggggctctaaaacaatgcaggttgactgtaattgttaaaatgaatttggaaagtatttgaccttatctgttaaaattaagtatatgcataccctgtgaccaataattctgctactatcatccaacaggaacacataaacatattcagcaaatgtacaaaattttttattaaagaattattcacaacagcttaaattggaagttttgcagttatccatcaagagtaaaataaacacatcatagcatatatatacatacatggagcattatcaagcaagaaggataaatggtatacccaagagagctttgatgactctcctaaatatatttctgagtaacagaagccatccagaaaagaatatatattgtttaattctattataaaagttcaaaaataggttaaaaaaagtctatgttattagcaatcagaataataattacttgcagatagagcagatggtaatttaagggaattttattgtgaaatatgtacaatcactttgttaaaattaattaactatatactatttgtgtatttcaataaaaatgtttaataaactatctcatcgttgttatttacatttattaaatagcatttaggcatgggtgaaaaggtttaacttgactggcctgaattactcaaatactatacattccaaagaggggtccctctgcaggactagaccttagactaggagttcatctctgagcccttggagtattttgcttgataaaagtgttcttgttttcctaaagtcttgggccatactctcccagttggaccagaaaaggttatgttatcaacgtgacttatgtgaacatctgtttttactctgggtgtaggaagaaagttgtgcttaaatgtcatggagctgaggtcaatcatatgggcattacatgactatgtgactgatcccagtaaacaccttcgacaactagactccagcgagtgttcctggttggcaatgctttgtactttacatattgttgctgggataattaaacatgtccccatgcaactgctctgggaggggacacctgagagcttggacttggtttctcctggagttcacttcatttgtcttttctcttagctgacttctatctgtactgtttttactgtaatatactgtaacaatgagtactacagcttctgattcccttagagacttccaataaattaccaggtctcaagtggtcttgggaacccctggcatattactgaacttaaagttttcagaatatctgtatttggtatattccatggcaagcactatatccatcacactttttcatttattgacataactccaaatatttccacatatctaaaattcaggaaagtaaccctatccttacctctgaggataaagcttgttaagcataggtaaaccatgataatttaaattcacctgtttgtgactgactttttttaatgactgtttttagtcaagaaaatgtgaaggtaggtctgccaagagctactgaaaagagttacattttctaaaaaaaaaaaaaaatcctcatcttttctctttgagaataatttgtggtgtttctgaaatcattgtctgcccataaagagagattacttaaacaaaaagtctgtataaaatatgactacagagaaagatgagaaaaaaatcatattcttgattaatttattgatctattaaattaatagtctaggaagtagatccctctttggacttccagttagagacagggccttactctatggcccaggctggagtgtagtagtgccaccatagctcattgtgtagctcaccgcaacctcaaactcctggactcaagcaaacctcctgcctcagcctcccaagtggctggaatacagacaggtgccaccatgaacacacctggctatttttttttcagttgtagagctgaggtctccctatgttgctcaggctggttttgaactcctggcctccagtgagcctcccacctcagcctcccaaaatgctgggattccaggcataagccaccagacctggcctatttatagtttaaattttctcatcgtctaaataaaagatctaggccgggcgcggtggctcacgcctgtaatcccagcactttgggaggctgaggcgggtggaccatgaggtcaggagatcgagaccatcctggctaacaaggtgaaaccccgtctctactaaagatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagatctaaaactaattgtctaagttggtggagcagtcagaacacacacatttattgattaaattcattgtcttatatggatgtggttcatggtgcccaaaacaattacaatagtaacatcaaaggtcactggttacagattatcatatcaaatataattatagttaaaaagtttgaaatattgtgagatttacctagatatggcacagagatacaaatgaacacatgctattacaaagtggtgccaataaagttgcttgatgcagggtggtcataaaccttcaatttgtgtaaaacacattatctgtgaagccaagtgaagcaaagcacaatcaattgaagtatgtctatattccactgcctttttagagtgtatatagttgtattacataacatacataatatatatacaaatatatataatatatatacaaatatatataatatatatacaaatatatatattatatatacaaatatatataatatatatatttgggtatatgtaatatatattatatatatttgtatatatattatacatacatattatatacatatatagtatacatatatattatacatatatattatatatatatatatatatttgatatggactgtgtcttgtttccccaaaattaatatattgaagccttaactctcaatgtgttagcatttggaggtgggacctttggaagtaattaggtttagatgagcccataaggatggggtcttcatgatgggattagtgctcttacaggaagagaccagagagctaacgctttctattcactatgtacgtacataggaaaaaggcagccctttgaaagcccagaagatgaccctcctcagacttgccaggttcaagaactataagaaataaatgtctattgttcagaccagcgcctatcttatttttatatagcagcctgagcttactaaaacaattattaagaaaaaacagcaaagcaaacaaacaaaagcaactatgtttaaaactcctggaaaaataatttatcttctgtgcagctgtttttttaagattttcctttaatgtatttcctctcatttttcttgcgtcttatttggagtctgtagtagcatagttcttaatttgcttatcaagtaatttacatcatattaaacatgaatttcaaccagcaaagaatattattaaaacttctggactaatgttattcacttgtattctttcctactacccggaaatgcttttgctggcaatgatttctcctttgatgttgtgaagtttcgggccattgttagagaaacaggtccacttgctgattagcaggcagtaggctttgtgacctaagttcagtaacagaagatcattactttctctggcaatttgatacaacatgcttcatatattccaaaattcatcaattttctgctccgttgatgtcctcctttattatgttaaagagttgccacagtatagtttattcataatgctattttcagttgaattactagagctccactttagcattttaaaatcatattatcgcatgtttatttccaaattaaaatcctctcttaaaaatcagggatatcagtattcatctctttttatgtaaaaatattaaaaaattagaagtgaaatatcacagaagatattttaaatatgaagacaaataatgaaataaggagaattttaaaagccaaatattttggatcagagtaagaagttagtggtaaaagataaaggttatccaacaaccttttgcaaatgaagccaaaaaagtaggtttgtgcaacagtgaataactaaaattacaactcttttatatttcattaaaaaacatgccctttttcaaaatgtcagatcggtttaatcacaccataaaattatttacccaaagttaaggaaaaatagcatactgtcatataagtagaaaatttaaatacacaattgatatttaacgttctctaagcaatgtaaagatttcttttaagacatctaacagagttgtatttattattagggatcaaaaagtgtgtaaattagcacaatatattttatataaaatgaatctgattgtgttttctcttataagagtatacaattataattctgaattttgaatttattcttaaacaaataaaaacaactgctatatctgaattcttgttttatgtcactcttgtgcatattttttactatctatattttaggcattttctaggtttaagtatgcacagttggagcttactcaatatagcctagcaatgctccctgtttcttttttttaacctttaatttcaggggtacatgtgcaggtttgttatataaatacatttgcatcatgggggtttgttttacagattaattcattacccaggcattaagcctatgactcattagttatttttccagatggtctccctcccccgaccttctgccctcttgcaggccccggtgtctgttgttcccttctttgtgtgcatgtgttctcatcatttagcttgcacttacaagtgagagaatgtggcatttgttttttcgttcctacattcatttgctaaggataatggccttcaattccatccatattccttcagaacacatgatctcattcctttttatggctacatcttattccctggtgtatatgttcaacattttatttatccagtctttactattgatggccatttaggtctattccatgtctttgttaatgtgaatagtgctgcagtgaacatatgtgtgcgtgtgtctttataatagaacaatgtatattcctttggatatatacccagtaatgggattgctgggtctaatggtagttctgtttttaggtctttgaggaatcaccacactgttttccacaatggctgaattaatttacattccctttaacagtgtatagtgttcctttttctctgcaaccttaccagcacctgctattttttgactttttaataatagccgttctgactggtgtgcttactggttcttaatctcacccacatcttagaataatgtggaacatttcaaactacccacacctctttctaaaaactgaagttctgttttaattggactttagtagagccaagaaatgagtattacttaaaatcttgccatgtgattctactaggaagccagggttcagagccatggattacatttttaatataaatacacattattagttgaagcagttttaagttaggatagctgtaacgttgattgaaaggggaatacttaaaacagaaccctgccttaggtcgtcaagacttaaaaaattcttctgtttttattctattaaatataatcatgcattcatttactttagcatttataattctaaaacacattgcaaatttcacaaaactaccattttctaaatgtcaacactctaaatacaccatttatttttcaaagtagtatattcacttcaaattccattgctgtgtcaagagttagttgaacttaaaatataattaatagttactcagcaaaaatagaaagatgttagctgactgtgtcaaaagaaatattttaacactgatttcatttttactaaatgactgaatttttctttatattttatgcttaagcttctctgctttctttctattttttgtggtttaaataaagaaccatgattatctgtataactgattgctcaaagtaattaatcatttttcttatgaaattaccagggtaaattaagaatcataattacagagttttctcttgtctagaggaaacatactgagaaactgtgttaggaaattattatttcaaaacccagtctaagttctcagccactggactttaaaaaatacatattacatatactttttctaacatgattgagaatatagtttgtttcagatttccacatttcttaaatgaaaacaataaagaattcaaaaggcaaaaggtactgtaaaaaaaaaggtattcgatctcatgtaaatgagaatcctacactctcactgaattttactagaggggaacttattgtcacatcagattgtttgttcaagacactatttctgatgtattttattaaagaattcaaaaggcaaaggtattgtaaaaaaagttatttgatcacatgtaaatgaaaattctaccttcttattgaattttactaattagagggataattattctcgcatcaggttatttgccaagatactatttctgatctattttattaaaagtcaccatttatcattggttttcatctcatgttatatatgcaaatgaaactcctttgagtatgcaacggttatttactgcagtgaatatcgtataatcatatttatcaaaatgttcttctttgaaatatttttctagtgcttattagcaaacagtttttatatttgagaaagtgaaacgtggactttagaatcagatttaggccatatggtaagccagttgcctgaaaaatcttcataacaaatgctaatattgatgaattttggagatgtcattatatatgtatacctaaaactacaggaaaacaaagaaacttaccaatgccagaaacacaggcaacacttaaaaccagcaagaccagttgctctgacttttctggatggcaagagagatggacccagcaatttataaatttggatttttttttttttttttttttttttgagacggagtctcgctctgtggcccaggcgggactgcagtggcgcaatctcggctcactgcaagctccgcctcccgggttgacgccattctcctgcctcagcctctcgagtagctgggactacaggcgcccgccatcacgcccggctaatttttttttgtatttttagtagagacggggtttcaccgtgttagccaggatggtctcgatctcctgacctcgtgatccacccgcctcggcctcccaaagtgctgggattacaagcgtgagccaccgcgcccggccaaatttggattttcttaatgctcatcagcgaaggggtgatgcatagctggacctagattgaaagagtaaagaaaaatacttattaaccaacccagtataattaagaagtttgtctgtaaatactagaacaattggtagaaaaaacaaatacatattctcccctgagaatctgtaacatcaggattatccatcatgtgttgtttgacttcaaatttttaaattgtacagccttgaaccatgaaccatcaaattaacaaattaacatatagattattttctggccattgatacactggaagttgggtggaagagatgcaaaatcattccagagcaaaagctgaaaatttttttctgcaaagggcaagataataaacatcttaggcattattgaccattttaaagagcagcttatagtcaccaaaaggaatatcaacaaactagaaagtgaagatgaagaattatccagaatgcagaatatgaaccaaaagatagaacataagataagctgaaagccatggaggattgaataaaactatccaaggaatatctaaaagaaattctgaaaagagaatagtaggaataaaaataatgggattataatagtttgcttctacttctgggatgaatgtagtagttgtataagacacatactcttattaaaatgacaagaaaaagctggataaattataaaagccatatattttttaaagcatgagggaactgtagaaacaatgatgaatagatgaactaagagtacagacatacctgagtgttcgaaatgggccaaagagcatgatgcattcatagcgtctactagtcaattctggcacaaattaggaagtagaaggcatgttcaatggaggcaaaacagtaatatatatataaacatgtgggtaagtctaaagaagcatttgctatattgaatcaaacaaatacaataaagtaaaacaaatactagagaacatcgttaagctgagttaagtttggctcaaagtgcccattgtacttgcctaattaagtttggcccaaagcggcatccatacatagtgactgtactctaacttaatgtgtagataagttgtaagctaatgtagatatatggacttgtaaccaagcaactgagactcaaccaatcataggagccaaacccttagtcaatcctaggctgaatgctgccaaattatgcccaaataaggcaaatattgaactgcaccaatcagggaaactctgaatataattgtatatgttctggttataaatacatctcaccactctggatgtggagtcactctgaacaatctttgttctgggatggtgcctacttctcaaacctttttcttggtcaaataaacttagtgaaatttaacatgtcttagttgcattttttttaaacaacattcaaagacctacaaaataggacagggaacttgtatttagactatactgtctaaatgcaacgtatttatgctagttatttgtgtgttatagagaatatagtgatattgatatactttaagtcatttatgtacatcgggaagaggaaaaaaaagttacccaattcaatggaagtcaaacgaagaagcagaacagagctaccagaaaaacatgataagagttaaagaagatgggagctcaaagaggaaaactgtcactgaatttggggaacttttccttgcaagccaagttaacttttattcagatagaattctcagatgaaaaagaaattatagtctatggctgacaaaatatagagagtctgcccagagacttttgctattctaagctagaatcataaggttaatacactccaatgaaggagaaaacaagaaccagctcttgagcatacttgaagtctgggaccaaatctgagttgttcagatactcatattttcaccctgatttaagatgatctgatatgggtaatgcttgcataagcaaaacttctggaggaacttacctccatagtagacaacaaggtaatcttaaactatcctgacactaattgggtgtataaacttggccaagtaatttttccctttgagtctcagtttcctcaactgtaacgtgaatatgaaagtaactaacttgtaggtctatattaaaaataaagtcaattattttggtaaatcatttgtatgcaatatagcatacatgagagagagagagagagtttgtatgcatgtgtttagagagacatggagagagagacacacatacacagagaagaatcagtatattgttaaggataacaacatccagaaacaaatcgacagacaagaaaaacaatttaaataatagaattatcagacagaagttaaagaacaaaacataggcttaaagatgcacataggaaaatacaaatatgatcatggtagatttagaaaggaaatacctgctagaagtaacagagaactactagaaaattaacgaagtgcagtaggaagaaagaaaataaattattgaagaaaagtttcaagatacaaaggataaagttaaatgttaatatatgtctaaactttaccaggaaaagagagacaaaggcaataactaaggaaataatagagaatgtttttagtactgattgaagacagatataagcagatttaagaaggtcaacaaattctgagtggagtaagaaaagtacaatgaagaaaacaaaagacaaagccaaaattctgtaaagcagcctgaaaataaggcttattaccattaaataacaacatttcagtctatagaaacttacatcctaggagagggaatactttaaataaaaaagtaatggatgaaaagagaaaaattccatcaagtgggataactgttatccataaagaagtagcaggtgagatggggagtaaaaaaacaaacatatataaatcctcttattttatatattatagctcaattttattcccatctttgataatccaaaaattatacactgatcaatatatctgttctaaatgttaagattccaacaggtagatcatgtctctcaaaatgtgttgcacattgcctcaactggaggttcatgatgcatattaaaataagaaaggcttagagaattcttacagcaaggaaaacaatgtaagtttatttaatttagtgttttagctatatatttaataattattttaggtaggcagttgtttaaagacaatagaaattacttggaatttaaagcaagcaaaaatgaatgcgttggaaaagcacaatgcagctcttagaattgaaaaaaaaagtaggtgaaccagcctcaggcaggaatcagagagcaagtcagaaccaatatcagaaaaaggaagttctgcttttcatgtggctattgtcctgtcagtcatgaccgctggccactgccagcaaagcatgcacaggcattttctggaatgctgctgggctctgctttagcttgtcacttcccactttaccattggattcaaaaaatctatccatctgacaggaataatttcagactctctgcctacttcttaccttgcaaggttaaaaatgcaaggaatgagtggctattcttgggtctctggtttacattttagcctccagttggtgggaagagaaaaatctactcacaaacagcttcaaaacggaaaggtcctatattggcattcctacataaaagaaagtactggggggcttgacaaatggacatttgtcttcaaagaacacatattctcctttagacaaagtttgcacttatatagcacaattaacctacttcttatcaatcaataaaacgaagagacaattacagaacaggataaggtgtttgcaaactatgtattcaacaaggtttgatatccagaatatataaggaactcaaaaaactcaatagcaaaagaaaaagttgattaaaaaatggacaaaagaagacatacaaatggccaaaaaatatataaagaaatgctcaacatcattaagcctcagaaaaatgcaaaacaaaaccgcaatgagctattaccttatcccagtttaaatgatggatattatcaagaagacaaaatataacaaatggaaacgataatgtggagaaagaggaatgttacacactgttggtgggaatttaaaatagtatagctgttatgaaaagcagtatggagtttccacaaaaaataaaaaagagaactattatattacccagcaatcccactactgggtacgtaatcaaaaaaaatgaaattagtatgtcaaagagacatctgcacccagggatattgaagcatcattcaaaatagccgtgatatggaatctgcctaaatgctcatctaacaacaaatggataaagaaaatgtggtgtataaatgtatatctatctatctatctatctatctatctatctatctatctatcatctatctatttatcatctatctatccacccctccagaacaatattcagccataaaatgctgttatttttagcaatgtggatgaagttggaggacactttgttaagtgaaataagccaggcacagaaagacaagcactgcatgatcaaattcatatctggagttttaaggatatggagaaagatgttaggttttttccttgtgtgaacaatatttaaaattattatatttggagagataactagaatacttctgccaacttaactatgacccattgaattgctctgaattataaatcagatactctgaattagcacttcactaccatttttaaatctacagcatttatataaattaataactgctgtagagcatactactcatggctgaaaaaagtgacctgatgattcgagctatctaagacccacctgatgtctgacagcactaaggatcaagctatcacctctcccttaacacatctttcacaccagtgtgctagagcagatagctgaaaagttttccctaagccagagatcattctgacaaggcatgtggaacaatggagatgtcagcatgctttcaagacaagtaacagtaatcctggctgttaacttgctttaataataatgaattcttttatcaagtcctgaggaatgagggcttccaggtgccgtatttccaggtgcttatcagaatttttctttgctgataagaacaattgttgcagcatgctttgctaatcatatacagaaagacaagaaatttatattctaataatagaacacaagtccatctcttgcatctgatttagccagattaagtcacctttccaccaatatcaatctggaagtgatatcatgaactaaatggtgtcaacctggggtttgtattatatctcgacaaaggaaaagaagttgccatcattggcaaggtacatacaggatacatctctgtttcggcagatgggatgagatttccctgattctcctacactgcagagggtagagggaggtatttatataatacacagaattttaattgaagaagcaaagaggaatggattaatgggattaatagtgtttatccaatacaagataaaaaacaacatattattgtttgtatcatgatggttctagaataaaacacatcatttctctaattttagttagatctttgctgaaagaaaaagataaataaaataccctacagtttatccatatccatgttcctctacactaaatattcatctttgattagttatttttaactatatttgatttctttataaattaccttttgaaactttaaacacataaagacattgtttccccttaaaagatttttcttttcctttctttttttttaatctaaaacttactttcaaaaacaatgactttcataaacttgcaacttgttaaatatagtatttttattaacattctagtttgtaacacaaggcaaaacctaaacacttaccatttataaataatgggtaatactgtttcaacttaaccttgagaatgtagaaaaaaaattgagtccagtctgatagcaaccaaaagatctcagaaacagtaatcttagtgctcgcctggcagacacaatctgcacagaacttaatcaaaataagattaaaagtccatagcaatttccttgagtggccagtcagatatcccccattacagtcaccaaccagcctgcccctggggcctatttcagaaataaattggtttgcagatgagctgatgcagaagaaggaaaaaaaaatgttttcttgagactgtacctaaatcttatcaagtaatacagggaagcttcaaagtctttttattctgaaatgttattttattctgctttatatcatcttaaatttattagtattatattaaatattagtttatgtaagcttattatttgactctgtataggatataatagatggcattgaatatttaataagatagcaacagcaataacacctgggaaattgttcagggaaggattctattcagttattaaaagatttgcatacttatttcactaatattactagcaatcacaagcattgggtaatgctagacaaatctgcaagaggtaccgttattccagcaccttaaaaacatttttcaatctgaaagatacttctagatgtttttttccataacagagcagatgatttctaagtgtttatatcactgaaacttcacagtattagtggaatatgttatcctttataccaaaagtaatcagattattttataaagcaattatcaattaaaagtagattactaagaacatactgtataaaatgccttatgggctattaattctgcatgcattgccacatttgattgtctcaaaaaacctcctgaaatatgtattcttaacacacttttactgagaacattatgagtaataaaagttgaaagattttcccaaagatgtacaagtaaaacaggtcctcaaataaagttgttttattcaatgttgttttgctataatgtagatgagaataaatattgattcctggacagggctaccatctgtgtagggtctgcatgttctccccatgcctgcatgggttttctccaggaagtcctgcttcctctcacatccccaagatgtgcatgtctggttaattggcatttccccactgtgtgtcccaatgtgagtgaatgtggttgtgccctgccatggaatagcatcctgtgcagggtttattcctgcattgcatgctgagtaagaataggttcttgccacccgagactctgaactggaataattgggtaaataatcatcttacttgtttttattaatctttttaaaaatgtatgtatacctcacacttatttcagtgttgaatgttataagtgttttagtctccatttagaagtacagtgataatattgtgaccagaaatatgcagtaggaacttatatcttgttgtatcaattggcctatggtaaaatttgtttcattgttcaccattttgctgatagttgcagtttccaataatctactgatattaaatgtggacttactatgtaaacaatagcaaggatcctaaatcctaggtcatatctaagtttaaatggcttgacaccaagtcagaattgccttatgaccatgctcttataagtgtttcattttttaaaacagtgcaaactgaattttgcatgagaattatcattaaaaaaatttttgttacagataggatcttgctatgttgcccaggttgaccttcaagttctgggttcaaatgatcctcttgcctcagcatccagtgtacctgggactacaactgtgtgccaccatacccagggctgcaggaaaagttgtgatttcataaagcagtgatttatgaaaataagactttatttgggcaacatagaaaacgtaaacaaaaagagttgctcaacataaaacttactcaagtcacaatttacctctgacatgacatatttccatccacttcagaaaaaaaagtgtatacctttttatttcttttttttttcctttttttttttttagacgggctggagtgcagtcacagttcactgcacctttgagctcctgggctaaagtaatcttcctttctcagcctcctgagtagttagaactaagacatgcaccaccatgtctggctaatttttaacacttttttgtggagatggagtctcgctatgttgcccaggctggtcttgaacttctggccacatgctatcctctcacctcgaccccccaaagtacttggattatcggctcaagtacttagatgtattaaccaggatcacagagagcttgattttgtaagtttgagtcagcatgtaataactgcagttgattttgatgcatgtatttaatgagaatcattgctttagactatatgatatttaaaacaaaagagcaataggactgcatggcacaatataaagtctgttatgacatagtgactttaatatattttaattaaaattataatagtaaaagctaaaaatgacaagacaattgttagaaatcatatcacgacagcataatcatgtatccacaagtgattgatacaataacatgaactgactttttgctgcaatattaatcagttaatacaggtttttaggtttcagttaactggttaatcataaaatattatataaaatattatcaaattgtgtaagtcatctcactgtattctaaaatttatgttattttatatttctaatctatgttttgcagagatcatgaaaattttactgggtaactgaagaagaattgtcccaaggacttgaataaatgttaatgttcataacagtatgttctaaaaagaaatttaagtaaaaaaggaaaaaacatatttcattttaaaaatatctacccatgcacatcattcatctaaaaaacccatttaatataatcatctagttatgtaaagatatacccaatagctacttaaaatagaaatattctatttcattattagaaattattattttaaaaggttgttaaaacatcaaaaatatgcttatttctagtaaccagagaacacagcagggttatgaaactttggattcctgtttgatttggcaggtaactagattaacaaaaatacaaggttttgagtttcaaaacagaatagcatatttaaaaaatacttggtgggtgtctggcaattgagagaccttagtagcacaatcattggtcttcacaatcactgccaggtactctttcaaactagcttgaataactgcaaaacacattatcaacccagcttctttttgctggacctgggcatatataaactgattagatttaaaaataaaaaagagttttttcagttgtgtttgaagaggtgaatccttggactcaaaatctctcaaaagtcctgtctttcacttcagaatctgcattaatttgcacaggaatatacttctgtgttttaataaacacatgcaatttttctgttttcatcttgcaagtaatgacagctttgttctcaaaccaattttgttttttgtagattttaccctgatatataatgaagagacagttgcatgatctgtgtagaaattcttcctctaaactaaattatactaccttagaaatctgacatgaaagtaccaaaactatgtaaattgacctcaccaagaaaattattacataaaacagtgattcatggaaataagacttgatttgggcaacatagaaagtattaaaactaaaaaggagttgcttgagataaaatttacccaagtgacaattttacctgtgacaaacatatttccatccactgcagaaacaaatgtgtttagtttattaaagtatatgtttaacagcaaaaaataaatagaataaatttattatccctatccagtgataaacacaattttaaaataaaaatgaaaacatcctgcttatatttgctatactatttcatgcattaggctaagatatatggttatttccatgctttcaggatgtgtttaacaaatctcttatacattttcctattgttgtcattttaatatcttgaatataatattaaataaacatttctacaaataatttgaacctcaaagtttcataaacatctatccttcaatatttaggcctaaaaagtaatctccattatctatcaaattctaaatttgaacttactatggtttactcctactttttaattattactttggttaaagatacttcatgatattattaagttccttactaataatgtatatggttgtattacattcatttatccatcaagactaactttgagctactatgaaatataattcaaatcattcacataatatctaatgaatgattactataatacaaagcactatactaggtttcataagtgatacaaaaacaagtgcaaccgcctcagtaaccaacacatttgcagtctaatagaggaaaacaagccctgttataagaataattatagtaaaaggctatataaaatacaatccattttgagacacaccttcaactctatttgctaattctcattttcactctttagtttatttttagattaaatagttattttcacaaatcagtctgaggacagagttttttgttttgttttgttttgttttgttttgttttgttttgtttttgtgagtcatcagcactatgcaattgcatatacctgttgtgtttagtctacaaaggctgaacatcatgtaatagtttttatgcattttgttcataggttactgggtgctttaaggcaaaactgaatgagtttccaatagtcagtacaaaactacaagaaatacaggcacaaagtgcctggggttatcctcagatgaagttagatttgaattgcattcaataaccttttttacaatgtgtagatgctcaaagcaaatacaatagtttctctttgcctctgtgacttgagttcatagtgttgtgtttaaatataacttttgtaatgtctacttcactgaagaaacttttaaaaaatttgacttataatggttttctgtaataacctatggtgcttggtttgtaaagtaaaacaggaactcaatttagtacctactgaataataacattttttaactgagattccactcataaggcacctaaatttttaaagttaaaacatattatattgacattaaatttaaaaagaataaacaagttagagaagaaataaaaaaaaatcttcagagaataaactgcttccaagtacacaagtactaaagaggctacacactggtatgctcattataaataaaaacattcattcatgtaattttatctcattactacatatttaaaataatctcttatcattatagtaggccatcattttccaaatagcatcaagaatccttattttgaaatagtaatcagatcatgtagttctcctgatcagatctcttcacactctagaataagatgcataccttcattttagcttttagactttttttctgatctagctctagattattgtttgatctcatttttactattcttctcattgctcattcaattcaatttcaagcataatgattttttgctctttttggaatacactagctttttgatttcattagagcctgtacacttccctcttcctgaaatgttcttccccaaatttatgtatagcttattttctctctttgttcagggctcagtgtaattgtagattgttctctaccttgaatatgtcttacccctcatttgactggttttccttcataccaattatttgtattctaaaatattttatatttttctgttgacttgttcactgagttccttcctctaaaatgtagcttcatgaggtcaatattttgttaaaattgtatgctactgtatcactagaactgagaacaatgcctgaacagagtagctactcatgactcattggctaaaacaagttaatgaatgagaacaggcaggtagaaagccaggaaggaaaagaggatattatattaagttgaatgagggattaaatgaatataaataagctgaaagtagcataggttatgcaatatgcttaacaaagtatgtttgtctattttcgttatgtaatccaaaacctggccgaccacaaaacttgctttttattcactttctctttcttccctgtttagtgcagcataaaattagttatcgattttatctcttaatgctccacctctattagtgaaaggatcttctcttatcatatttccagtccaaagttcagtggaaactttttacactcttacagtctatttgaaatccttatatcataaacataccagcacttatcccagcactattcacagtagcaaagatactgaatcaacctaagtgtccaccaatagatgatttgataaagaaaatgtgagatggtaccatctcactccagttagaatggagatcactaaaaagtcagaaaacaacagatactggagagaatgtggagcaataggaatgcttttacactgttggtgggagtgtaaattagtttaaccattgtggaagacagtgtggaaatttttcagggatctagaactagaaagaccttttgacccagcaatcccattactgggtatatacccaaaggattataaatcatcctactctgaagacacatgcacacatatgtttattgcagcactgttcacaatagcaaagacttggaaccaacccaaatgcccaccaacgatagactggataaagaaaatgtggcacatatgcatcatggaatactatgcagccataaaaaatgatgagttcatgtcctttgcagggacatgaatgaaactggcaaacatcattctcagcaagctaacacaagaacagaaaaccaaacactgcatgctctcactcataagtgggagctgaacaatgagaatacatggacacaaggaggggaacatcacactccacagcctgtcagagggtgaggggctaggggagggatagcatttagagaaagacctaatgtagatgacaggttgatgagtgcagcaaaccactatggcacgtgtatacctacataacaaacctgcaagttctgcacatgtaccccagaacttaaagtataataaaaaagatttccacctaaagataagaagatatgatgatatacacagtggaatacaattcagcctttaaaaataatatactcatgaaacatgtattttggagcagtttggatggaactggaggacattatcttagatgaaagtcagacacagaaagacagatactgcatgttctcatttatcaatgggaggtaattaatgcattcacatggacatagagtgtgcaatgatagagacttggacatgaagacttggaagagttgggggagagtgagaggggagtaaatgataagaaattacttaataagtacaaggtatgctttttaggtgatgaatatgctgaacatcctgacttcactatgcaacctatggatgtaacaaaattacagttgcactccataaatttatagaaataaaataaaataaattacattttaatagagacactatcagagaaatacaccgaaatgactggactgaattggaaatggaaaatgtagaaatctcattttctcttcagagactattgcaaatttgtatgtatgtaatacactaatcacatcagatgccagttttaagaacatattttcctccactgtgtagatttgtttcaatacggaaaaatttcagaacatacgtaatcaatacaaagccattctcagtaatttattttcattccatgccatgttacttaggtttacatttactaccttagaaaacattatgtacaaaagcttttctttcttatagtgaattaaatctccaactgcttttgtttctattttaagaaagtaaatattatgacataaatgtttgcaatgtttttgtttaaataaagtatttctagatttctcttaattcatagttacgtttgtttctttattgatgttcaaacacagacttttaaaaattcatatttttttcaaaatgtgtaactatttactttctagttcaatttaaaaagcatttaccataaaaatggcagtatctttttgtacagatgctacctctgaatcaaagcctctcagcaactggcaaacaggaagctctaatgcactttaaccctaatagttataaaatatgcaatcatctgaaatcacatactgatttccacttcttttctaactacggttatatgtaaatatttcactttcaataatagatctttgcctgtttatttagtttttttttttccttggcttagaaatagtttttatgaaatattcaaatacaaacatagtctctaaaagcaaagtatggttctttgacagccaaaacactttcccctaagcatttcattagttatataagtgataaatgtttttctgaatgggaatttacctaaagtgtttcaaaattaggtgaccatttgtgctttccaaaccatacagaactttatatttattcctgggtaaatcacccatttccttgttcatcaagatcaggtgaaatgatatccatgtgagataattaattcctctgctatctattttattatacttagttattcatctaaaataaatatctactataacaagtaaaatatataatagtgtagaagacaacaagagtatgtgtttgcagtatgtgtaatagagttaaatatatctaaatatagtatatctgtactaaggcaatgaacatcaattgtagctaatcaccctcattaaagcaaagggcactaccatatgtgacatagttgtcattgacagcctgttaaatcttgtagctgaggtaacggacagggaagagtttgtgatagtgaaatttgtagaactaagatcaaattaccaaacacgtaggcattattaaacaaattctcaccaattacttcaaaaatattgtaacttctatttaatatttcttgtttttaatcttaaaaactctaaattgagtagaatttgaaatagcagtaaatttcaggttaatggaaatacaatcacacttgttattattgttcaattttttttattaagtctgaagaaatatttacttgaatatgacatctaagaatgatggacaaaagctttttaaattttctttccactcctttttctgaaagctttgatacaaaaatcatttgacacaaatggttttttttttgtgtgacaggatcttactatgttgcccaggctgaagtgcagtgtgctcatgcaatcctcccatctcagcctcctgagtaactgggactacaggcacatgccgccatgcccagctaatttttgtatctttagtagaaacaaggttttgccacattgcccaggctggtctccaactcgtgggctgaagtgatctgcccaccttggcctcccagtgttctgggattacaggagtgagccactgtacccggctgatgcaaatgatttctattattaatatcttgcagttattcttccattggataaccatcaatgtcaaaataaagattattagttactgaaggactgaaaaatcaaaaatcaacttcatgagatgctttacaaacaagtgttctcttttaatatttgactcagtaaaagtttttaagaaaagttaagtttgtgtttttatttgtgtatactctctagtgcttaaatgtatcaggatagaacttttctaaactaggtcagtcttttttccatatctatggttgaatacttcagttaaataaagcaatggtagatagcaaactatgttataattggcattttgggcacttgttgcaattaattgccaaaaaaagcatatctcaccacaattgatctctcgtttttccactctcatttatttcccttcactttcttcttggcttctgcaaaagcatttgtttttcctttttctttcttctttaaaaaaatatatttgaagagatttattctaagccaaatatgagtaaccatggccagtgacacagcactcaggaggtcctgagaacatgtgcccaaggtggttgggatgcagcttgcttttatacattttagagaggcatgagacatcaattaactacacttaagaaatacatcagtttgatccagaaaggtgggacaactcaaagcagagggagtgggggtgggaggggttggggctggcaggggggttgggggatgggagggtattggggtttgggggttggttccaggctataggtgaatttaaacattttctggttgataattggttgagtttgattcaagacctgggaatgatagaaagggaatgttcaggttaagataaaagactgtggagaccaaggttcttttgaagtcttacagtggctgcccttagagacaataaatgacaagtgtttcctattcagatctttaaaaggtactagacttttagttaatctctttagaactgcgagggccattttttcatattataatttatctccttcatgtctgtaacaaagataggaatcgctataaagtgtcttcccagtttctgcctaaccacatccctggatttcctggctcctggcttggcatatgtttggggttagccttctcccactgctaatttgtatgccataagatggttgttttgttcctcagtacatttatgtcagatataattgttactgtagtaaacaactattgtgtaaaaaaatgataagtgagtgtgaaagtaaaaaaaacaaatcagaaaatgaagcagaatgtaaataattgataaagacaagttctgaaaaaatatcaaattggattgaggagtcagacacctgtaagaggtttatttgaggggctaagcgtgctggtatttacacacatattacttcttgtgtctcttcaatttattggttcatttcaaaaaaccaaagctaaaaatcataaaatattcattaggtaaaaagaaacaaagttcaatgaatccatacatacataccaaagacctttgtcggatagttgacaagtatatttgcatatatgttttccaaggtaaaagaaaatttgtggctgggcacggcaactcatgcctgcaatcccagcatttcgggaggccaaggccggtggatcagctgaagtcaggcatccaagaccagcctggccaacacggtgaaaccccatctctgctaaaaatacaaaaaaatagctgggcatggtggctggcacctgtaatcccagctacttgggaggccgaggcaggagaattgcttgaacccgggaggcagagtttgcagtaagctgagatcaagccactgcactacagcctgggcaacaagagtgaaactctgtctcaaaaaaaaaaaaaaaaaaaaaaaaaaaagaaagaaaaagaaaaaagaaaatttgtaggatatggataagtaatttattttagaagaattttttttttgtagaatgatttgtgctaaagcaatacatctctttctatcatatactgatatcttgaaaacttttataacgtttcttgtcacattcagtattttaaaaataggattgattctaagttttgagtttatggtgtatttgaatattagagatattatctcttatacatttcaaagctttgctgcattctaaactcagtcctgccttagccttagtaatggcaatgaagtgcggggatagaatgttcactatttttttatgtgctgttaaaatttcatacctcctgttctatcttgaagtcttacagttttggaatggtgagtgggggaaacaagcataaaactattacataattcatgcagttttcactgggcaacagtatcctctgaatggtgaaatggctacttttcatttatttatttttttctctcctggggtaaaacgcttgaaaactgcaccactgggaaattgcagctatagtccatgtttcaacatagtccatgcttctttgagttggccacttactgtttactctcatctccttaggtttagcagtaaagacctgtaagatttcttctgttaggatcatctagccattccaaacatttctcttagatttgattctttcaagacaaatcaacccaataaaaatctcataaataaaggtgagctagctaccacatttggtgtactcatctgaccaaaccaaattttatgtatacattcaattctcaatccaacccagtctgtttgcctaagccattccagacaaacttccactttgaaggttttaaatgcataagtcagatagcaatccttcagttgccccagaggcacatcacgttctttgaatgcttcagtatagtcctcttcatttagcaatcagtgaggcaatacactggcatcatgatccctttttttaggaactctgtacaaaattccctttgaaaatataaattttggaaatgagtgatgagcaaaggggtttcattaacattatcacaatctcttgatatatctgcttgataatgtagcacctattatttggggccattaggaccttggcagaaattctggtaaatgtaaagaaaccacatttaacatccagttaatttagtttgtttgtttgttttgtttttgtttttgtttttgagacgttgtcttactctgtcacccaggctagagtgcggtggtgtgatctcgactcactgcaacctccacctccaccttctgggttcaagcaattatcttcctcagcctgggattacaggaacccaccaccatgcccacctaattttgtatttttagtaaagacggggtttcactgtcttggtcaggctagtcttgaatgcctgacctcgtgatccacctgcctcgacctcccaaagtgctggaactacaggcatgagccaccttgcctggcctcaatattgtttttaataatttctgctttacttgcagttaatcatatcaggccgtctaccatacccagttgtgtcagcaagaagatctgtacaatgataagtaacacatggctcccagggctaacatattcctaacacttatataaacactttttcagaaatttgacaatattttataattaaacaatatcttattttacaagaaaagatatggtatcacaatactctgagcaaagagttaatttgcttctcaaatttcctagataatgaagtagtcctaaaatatttaactcagtattggtaatagtttcaatttgaggaagtgttctgaatagcctttttaatgctgatgtcataagattgtgttacaaacacagactttcatttaaagacactttatgtttaattttgttctaaaaaataaaattatatataaatacacatgtatcctaaactatatatgtataatatacatatatgtatatatatacacagagagagagagagagagagagagagagaaggagagagaaacagagacaaagaaagccataaatcctgaatttgttgttgtcaatggtgtttgatagcatcactttgtaactcaataggatgtatctgcacaaagctaaaattaatttatttttgccatacaaggcaagtgtatcttgttgacatctatagagaaaataaatcaccctctaaagaactgtttataaataaataattgatatctgaaaattcagaaaaagtaccactatcattttacttaccatattgcattgaaattatatgtttatgcttctcttgcttctacctctctgtgaattcaaggttagaaaaggagaaatttttatcttagcattcccaggaccaatcacaatatctaatacttagagcgtgcaatgttggttgaactgaaataaatctgatataaaaacaaataatgctttagggaagtgatttttcatttgagattattttctcagaaaaattaatatgaccaggttttcatcctatgcaaacattagtatgccttattgatttttcactaagttatatagcttatattataagacttttttatgggtgtctctacctacagattccaggcactaacaaacctgtagaaattcataaatttaatgcattttatcaagttgattaatatagcatgaacatttttgaactggcttcacaaatcatttattgttaaatgttattcttatacctgtattagagagaaaaaagccagaggtggcaaggtgatatacagatcaactggaaatccacaagttttggtttggaactctttggaaaattgaataaagagtcacaccttgctcaaaactgaattagtaaaagcgatgcacatatcaataaacaaacttctctaataaaaaaaagcattaaaaatatagtcagcatatatttttctggaatataaaattgaggaactagaataattcaacttgaataagtgtaactaattcattttctgcaaaatattacccacagtttgagtatttttctatttattctatcggaaaaaaatgatataccactgtactggaaatattcagaaaagtttgtctattttttaaaattgtacttattatacctttataaccgtgagataatatatttattatttgaatgagaattaaatgtttatgatttatacaaaaatgcctgacacagactactatgcccacaaaagttgaatggttgtttttagcttatatatacctatacaggttaatagatatatctttacttcttttttctttttttttgagacggagtctcactctgcagcccaggttggagtgcagtgacatgatctcggctcactgcaagctctgcctcccaagttcacgctgtcctcctacctcagcctcctgaatagctgggacaacaggtgcccgccaccacgcccgtcttattttttgtatttttagtagcgatagggtttcaccgtgttagccaggatggtctcaatctcttgacattgtgatccgcctgccgcagcctcccaaagtgctgggattataggcgcgagccaccgcacccggccaatatatctttacttcttataagaaatgagtaactttattaattctaccaacagataacattcttcctctcagagattaatatgcaatcatttcctaaccttattttattgcgctatattttaaatataataaacgtgtcaaaaatgtggtttcatactttttataaattgatatatttagctaattacactaaatctagaaaatactattgtgcttattcaaacttctcttctcttcttcagaggcaaacctgtataatttctttggtttgtttgtttgttttaagacgtagtcttactctgttacccaggctagagtgcagtggtacaatgtgaggtcactgcaacctccgcctcccgggttcaagcgattctccggcttcagcatcccaaataactcagattaaacccttataatttctatcatgattgattaattttgttcatcttcaaattccaataattagaattcctacaggatgtgtgtgtgagtgtgtatctggtttattttctttagcataaataaatatttgagatttagccaaatatttgtgtgtatcatttttttatttttcctcatatttctgagttgcctacgtatttgtcagagtttgcttattcattagtctgttagtgaatattcagattgctttcagaattagcttttacaaataaaggacttaggtgcattctcaaacaggtttttgtgtaaatatatgcttttatttttgttggataaatttctagaattgaaattgctgtgctatagggtagatgtatgttggccttattgagaagcgaattatttttcaaagcggttgttccactttttttttttttgagacacagtcttgcgctgccgtctgggctggagtgcactggcgtgatctgggctcaccgcaagctccacttctcaggttcacgccattctcctgcctcagcttcctgattagttgggactacaggcgcccgccaccatacccggctaattttttttttttttttttgtatttttagtagagacggggtttcaccatgttagccaggatagtctcgatctcatgaccccgtgatccgcccgcctcggccccccaaagtgctgggattacaggcatgagccaccgcgcccagccagttgttctattttacactctcacaagaaatagacacgacttctagtttccccacatatttgccaatattagtattatcattttaaatggtagtctttccagtttcgatgcattttggttgcatttccccttatctaataacactgagcatcttttcacattcttataagccacttgtatctcttgttttgtgaaatacctgttcaagattcttataactatttagtggatctcaggagtactctgtgcgttttgaacacgcaatttttttctcatacatttatcacagtctatggcttaaaattatattttcttacattttgcagttttattaggatacatttttaattaatatctacaatttatcaatttttactcttatgatagtgctttctctgttcagaaatatttttcctattataatagctcgcagatattgtttaatttttttcttttaaaagctttctgaattttgctttttcatttttatgcctacattaaaaatattggactagttttgtgtatacaaaggactgatgcatgtatttttttaatatgagaatgcatttatttcaaaagcctttgttaaagacttactttccccactgaattatctacatgcccttataaacatttaatttactgcataggtggaggtctaattttgaacccttctttatccttattatttttgtgttatgatgctttgatactgcagctttcttagatgtctgaaaattggctctatttttttctcaaaattctaggtcctgtgaattttccaaacaaattttggaaacagcttgtgaatttctctcaaaatgtttgccacaatttactacagagttgtagtaaatagatatagaattcattgtagtcaataaactacaaactatagattgcattgatgcttttttttttttttttttttgagacagaatctcaccttgtcacccaggttggagtgcagtggcacaatcttggctcactgcaacctcagcctcccagattcaagcaattatcctgcctcagcctcctgagtagctgggactacaggcccgtgccaccatgcctggctaatttttttgtattttttttttttagtagagacagggttttatcgtgttagccagtatagtcttgatctcctgaccttgtgatccgcccaccttggcctcccaaagtgctgggattacaggcatgagcaaccgcgcccagccgctactgcattgattctaaagattaacttccagagaattcacatcaatgttgcatcttcaaatctatgaacatggtagatctttacatttatttaagtcttctgtaatgtttctctacaagaaattttaaaaagttttagtgtgaaagatttttaaaggtttcacttaaattattcttaactatttttataccattaaaattttacttttaaatgtattctcaattgtttatttctagtatttagaaattccattaattttccatattatattttgtgtattgaccttgcattctacacattctgcaccattattgaatttgattcttattattcacagctttttaaataaatatattaggattttcttcatatacaatatacatatatatgttctgtgaataaaaatattttttcttttcacttttcaatttttatgcttttcatttcttaaccccatgcaagtccgaaatccagaggggcagccaaatcttaaagctccaaaatgatctcctttgactccatgtctcacatcctgatcatgcagatgcaagaggtgggttcccatggtattgggcagctctgcccctgtggctttgcgggatatagcctgccttctggctgcttttgtgggctggtgttgagtgtctgtggctttcccaggcacatggtgttgttggtggatctaacattctgaggtctggaggatggtggccctcttcccacaggtccaccaggcggtgccccagtagggactctgtgtgggggctcccacccaacatttcccttcctcactgccctagcagaggttatcaatgagggccccatctctgcagcaaacttttgcatgggcatccaggtgtttccatatatcttctgaaatctaagcagatgttcccaaacctcaattcttgatttctgtgcatccacaggctcaacaccacgtggaagctgccaaggcttggggcttccaccctatgaagcaacagctcaagctatactttggtcccttttagtcacagctggagtggctgggatgcagggcaccaacaccctacactgcacacagcatggggaccctgggcccagcaaaaccattttattctaggcctctgagactgtgatgggaagggctgctgtgaagacttctgacatgcccaggagacattttcaccattgtcttggggattgacattcagttcctcgttacttatgcaaatttctgcagccagcttaaatttctcctcagaaaacgggtttttctcttctatcacattgtcaggctgcaaattttctgaacttttatgctctgcttgccttataaaatgaatgcctttaaaagcacccaagtcacttcttcaacgctttgctgtttagaaatttcttctgtcagataccctaattcttctgtcaagttctaagtttcactaatctttagggcacgggcaaaatgctgccagtctctttgctaaaacataacaagagtcaactttgctctagtttctaacaagttcctcaactccatctgagaccacatcagcctggatctcattgttcacatcattatcagcgttttggtcaaagccattcaaaacgtctctaggaagttccaaactttcctgcattttcctgtcttctgctgagcccttcaaactgttccaacccctgcctgttacgcagttccaaaattgcttctgcattttcaggtatcttttcagcagcatcccactctactgataccagtttactgtattagtctgttttaatgctgctgataaagacatacccaagactgggcaattgacaaaagaaaaaaggtttaattggacttacagtttcatgtagctggggaagcctcacaatcatggtggaaggcaaagaggagcaagtcgtatcttacatggatggcagcaggcaaagagagcttgtgcaggaaaactcccccttataataaccatcagacctcatgagacttactcactatcaggaaaacagcacaggaaaagcctacctccatgattcaattacctcccaccaggttcctcccacaacgtatgggaattcaagatgagatttgggtggggacacagccaaaccacatcaatgaagctctctgttgtatatgttaatgctgataatgtttttttgttttgtttttgagatagagaaggagatcttagagacaaaaaaggggaagctccattaaaattggtaaaggaagaaacataatatgaaaggagggaaataatgaggtaaaagatgcagagactgctttccagacaaagtaagaatgaacttcactttggaataacaaagcagtgcttgcttggcaaggtgagtcttagaatctgactaacatcaacagggcagagtctcaggtaattaacaaaaccaggaaggaacagggagcagcaatgctaaaacacaagaaaccaggttactttgtcctacttcatagttgttattttcctaatcattggagataagctatgattaacagaaaaactacccatgtaaaatattgtcacccaacttttaagaaaaacaagaaagaagatacaaaacttagcaaacagaataagtaatttcagagaatcagaattaagaaaagaaacaaatgtaattacagtaagtgtaattcatatcttcagagacatgcaagaagaggttacattttagaaaatactgataatagctcttggattaaaaactcaacagatgttctgaagagaacaatagacatagttaaatatagatctagcaagtttgaagtttaaaagttgaataattttctctgaatccaatggctaggaaaaaatgaagaaaggtaaagggaggtaaagtgaagataaagaattgttgacgtaaagttgtttaaaatgctagaaaaaaaggaaagtaaacataaagatggaaataattaaagaactaatttaaatattttttagaactagaaatactgtagatttgagatttaaagttttcatagaagtatgaacttatattaatggagaaattctactgacagacatctcttgaagaagcaatgggatactaatgattaggacagaatcataaagacttccagagtaggaggatagaaaggtaattttcaatggaataagaagtagatagaaaatttattcttaaacatgtagatgttgttaataactgggacaagaccatcaatgtctgaagaaataaatgtttttacaaatagtgtcctataagtacccaaatacgcatttaattttgtggacaaagcaaagacaattgtgcatatctcccaattcccaagcatttaaaaatccaaaaataaaataataaaattaacaaacagatttttagaattatatctggcaggagtttggatcagtcatagagcgcaatagcatacttgaaaataaggacaatatagccattttaatgatattgattcttcctatccatgagcatagaatgttttttcatttgtttcatcctctctgatatctttggtgtttttagttcttacagagatctttcacctcactagttagttgtattcctaggtatttgattctttttgcagcaattgtgaatcagattgcattcctgatttggctctccgcttgactcttgttggtgtatgggaatgcgagtaatttttgtatgttctttttgtatcctgagactctgccaaaggtgtttttcatcttaaggagctttcgggccttaagcttttgggcctataaagttttctacatataggatcatgtaatccacagacagggatagtttgacgtcctttcttcctatttgggtaccctttatttctttctcttgcctaactgttttggcaaggacttccaatactatgttgaacaggagtggtgagagagggcatccttgtcttgtgcacaaaatacactaaaataaaattgcttaaaactagtgataaagaaaaattctcaaagcggccaatgacaaaaacacagtttgcacagaggaacaaaaaatgccagcaaacattttattggaaacaaagaaaattagaagataatgaagcaacatctttaaagtactggaagataaacattgtcagctgggaattgtagactcagagaaactatctttcaagatgtaggtgaaataaagattttgttcaggcacttagaacctgaaagaaatcatcaccagtaaaacaacactataaaaaatgttaaagaaaatgtttcaggcagaagtaaaataatatcaaaaggaaatttggatctacatagaagaatgaaaagcactggaaatggtatcaacatggttaaatatataagatccttttatttctgtttgaattcaattgattgtttaaacaaggggtcagcaagctatagcttcatgggtggactgcctgtttatgtgaacaaatttttactgagacacattcatgctcatttgtttatgtattatcaatgggtgctatagaattacaaaagcagaattaagtagttgtaacagagcctaatggcacacaagcctaaaatatttagcttttaaggaaagcatgtccggttctggtggctcatgcctgtaatcccagcattttgggaggccgagatgggcggatcacgaggtcaggaaattaagaccatcctgggcaacatgatgaaaccccgtatctactaaaaatacaaacattagctgggtgtggtggcatgtggctgtaatcccagctactcgggaggctgaggcaggacaatcgcttgaacccgggaggcagaggttgcagtgagctgagatggcactactgcactgcagcctggtacaaagctagactctgtctcaaaaaaaaaaaaaaaaaagagagagaagaaaacaacattattaacctctaatttaaacaagaataataacaatttataatgagcttacaacatatataaaaataaattaatgacaataacagaacaacagttaggataaaataatgaaaatgttgttacttcatgatactgtatgtaaagtagtatattataatttgaaggtagaatgtgatgagttaaacatgtatactacaaactcaaaagcaaccattaaaattaacaatatagagagttttaattctcaagtaaaaaaggagataagatgaaaccataaaatatatttaattcatagaaaagaaggcaaacaagagggaaaataagcaaaaaacagatgggatggtaggggaagcaaaattttattaccatcttcttagttttttttttttcctctgctaagcctgagaattaaattgacataagacagatcaacaggaaaatgcatacaaatttattttaatgcatgtattatgtggcatgcgagattctttaaggaaggaagactccatgacataatcacttatgttctgaagtagacacagagtagtaaattgtgaaatatgacaagacaaaggagctggaactagtgtagttaattgggtgaagaggtgattaacaggataagggttggtttaacaaggtctgtttgtacaggtttcccttgcctcaacttctcatcctgggtgatgagactgttactttccttcttgtataaagagggcaactttcatgtagaaattttacctcctacttttaagaaaaaggaaaatcagagtgctttaaaggaaaatcagagtgcttttcttgcatctgctatttttcaagtgtctttaactcaaaaaaatcaatatgccaaagtggcatgtttgggggtatctggttctgaattccttcaggaaagatagaaagcaaaagcaaaataataggtttaaaactaaaaatatccaggtgcggtggctcacgcctataatcccagcactttgggagactgaggtgggcagatcatgaggtcaggagttcgagaccagcctggccaacatagtgaaaccctgtctctactaaaaatacaaaaaattagccaggcatggtggtgggcacctgtaatgccagctactcagaaggctgaggcaggagaatggcttgaacccaggaggcagaggttgcagtgagccaagatcatcgcattgcactccagcctgggcaacagagccagactctgtctcaaaaaaaaaagaaaaaaaaaagaaaaaaaaatatatatatatgcacacataaccacattacatataaatggtctaaatataccaatttaaaagcagattggatcaataaaacaagatctaagttattactgtctagaagaaattcaagaatatcctaataaaagatatctatgtaaaaacaatagctggcatcatacttaatgaagaaaaatcagtttatttcccccgatttcaggaacaagatgagtccattaactcttagcactttgttttaacatttcactagacgttctaccaagtaaaatagacaaaaaacataaacaaaagaattacagacgggaaaggaaaatgtagattgggtttatttatagacggcatgtctatgtagaaagtccactgaaatctacaaaaacactgctggctataataagtgagttagcaacataaaaaagaaaaaaagcaacatattaaactaatatttccatataccggcaatgaacaataaaaaattaaaataaaagtactattaataatatcatgaaaaatgtagaagaattaggaattaatctatcaaatgatgtgagagtctggtacactaaaactcaaaacactgcagaaagttaaagaagacttaaataaatggaaagatgtaatatgaatatgggttagaaaattcacatggtaaaatgtgattatccctaaatatagattcaatacaatcccaattaaaatattattaggcattgttttataggaatttacacactaattttaaaacttcagtagaaatgcaaagagtctaaaatagccaaaataatccttaaaaataagaatatttttgaaggattagcacaatctaataccaaagcttataaggctacagtaatgaaaatagtgtgatattggcataaagatagacagaaatgtcattggaagataatagaaaattcagaaatatatgtacagaattttggtaaattggtgttctccaaagatacaaaggtaattcagtaaataaaagatagcccttcaacaaattctgctggaacaattagatactcatatgcaaaaagtagaactttaacatgtaactcatgatacaaaaattaatttagtacagatcatatgcctaaatgtaaaatgtaaaaacaaagtgaaaaaaaaggaagaaaaattatgtataggagaaaatatagaaaagtatttgacctcaggctagtaaatactacttagacatgacacaaacaccatttcatcaaagtagaaattgacaacttgagttcatcaaaatgtaaaacatatgttcctcaggaaacactgtaaaacaaatagaaatataagacactactgagaacaatatttgcaaaatatatgtctggcaaaaaagttgtgtccagaaaacataagaactctcaaaacttgatgataaatctaacaactctaataaaagtaggcaaatgacttaaatgaatacttcttctctaaagaacatatgtagatagaaagtaaacacatggaaagatcctcaatatcattagtcattagggaattaatctgtgtctgtcaaaaatgagttgggtacagttgctcaagcctgtaatcccagcactttggaaggtcaaggcagcagggtttcttgaccccaggagttagagagcagcctgggcaacatagtgagatcctgtctctacaaaaaagaaagagacatggcatggtgtctctatttagctaggcatggtggcacatgcttgtagtaccagctactcggaagctgaggtgggagaatcacttgagcccaggaggtggagcctgcagtgaactatggttgtgccaatgcactccagcctgcgtgacagagcaagaacccatctcaaaaaagaaaaaaagaggccaggcgcagtggctcacacctgtaatcgcagcactctgggaggtcaaggtgggtggatcacctgaggtcaagagatcgagaccagcctgaccaacatggtgaaaccccatctctactaaaaatacaaaaattagctgggcatggtgatgcgcgcctatatcccagctacttgggaggctgaggcaggagaactgtttgaactcgggaggtgtagattgcagtgagccgagatcgcgccattgaactccagcctgggcaacaagagtgaaacttcgtctcaaaaaaaaaaaaaaaaaaagaaagaaaaaagaatggctaaagttaaaaaggctggtcatgccaagtgttggcaatactatagaggacaaccaacatacatgcactgctaatggtaatggaaattagtacaatgactctggaaaaaggcttgacagtttttaaaatattttgacgtatgcacctatcatatgactgccaatcaatttgtagggaaatgaaagtatatgtacataaaaaacttgtaccaaaacattcacagcacttttttataggagagaggggctaatagtgaagagcatgtaacaatcaaatattcattaacagataaatgaataagcaagctttgatatatccatattttgaaatactacaagcaataaaagaaatgaaactttcatccatactataaaatagattaatctcaataaatatgctaattaatagaagctagatcaaaagagaacaaacagtatgatatcatttatataaaaagaggcattagagcctagtagttaagagtgcagcttctggaagcaaaatccttagtatgatgttttggctcattgactgcagcatttattttatgtgcgctcttgaggtttttatagaaacaatatgcctcagtttactcatctatataatgactatatcgatagtcatctactttataaaatatatattttataatgtaatactttataatatatatttgatatatattttaaaatgtctttattatattttataaagtataaataatataaaataatatctatagttgttgacttataaaaataaagattaaatgaacaaaaatatgtgaagcactagtttactacctagaaaatggtacattctaaatatcttcatgattgtaataaataaatgtatccttatatgttattttattaataataaacaaaaatttatttttagaataatgaatataattatttttatttttagaataaataataatgaataataatattattattcattcttatacacctttgaaaaatcatagggtaaaatgattgaaattctgtgtatagcatctcagcagatgagatctataagaaagaaccattgcacccccatttacttaaatcagttatagtttaagttgtttgaaaaaagtcatttattggaatcaccacatgacatcaatcaagagcaaagtgtgtagaatactgtcaagtttttctccaagaatttatttctgttttcaatttgcaactcactgaagcattgaacattttatgagctctacagctaacaatgcctgggaatttaaatattttccatggaatatgattacttcaaatgaaaaaaaagaagcagaaatgataatgaataatttaccatttatatatggtacaaagtagaatctttaaaaataaagacacaaacagcaacaaccacaaaaacctcaattgtttctgcttttgttctatttttagtgaacttaaaattttaagagaaagtctttctccttgtttttaacacgtgtagagagaggtgtggaatattgtaaagctttttatctgactcggcctgagtctcactagatgaagactcatcgagtttagtaggccgaatagttttttctaaaagatatgtgacacgttaatccttggaatctttgaatataatgacacgttaaacagtgaatattaccttatatggcaatgcttgtgattaagttaaggactttaagggaaggggcttattctgaaatatactcacgggtctttaattcaatgacaaatgtttttttttttttttttttttgagatggagtcttgttctttcgcccaggctggaggagtgcagtggtgcaatctctgctcactgcaacctctgcctcccaggttcaagcaactctcctgcctcagcctcctgaggagtgggattacaagcgcctgccatcatgcccagataatttttatacttttattagaggaagggtttcaccatgttagccaggctggtctcaaactcctgacctcaagttattcgccctcctcggcctcccaaattgctgggattacaggcatgagccactgtgcctggcctgacaaatgttcttttaagagtgagtcagagggagacttgacacacagaagaggaggcaatgtgaccagggagcagagattggagtggtgcagcccccagaagctggggtaaaggaatgctcgcatgagtaaaggaatgctggcagcccccagaagctggaagatccacagaatggattctctctagggacctcagagcgagtgtggccccactgtatttaggacttctagcctctagaactgttttagaatacattgctgttgctgaagtcatttagtttgtgtcaatttgttgtgatagcctagggaactaatataatgaagcatggagagagagagagagagaggataaaaggtgaaaaccatgtgccaaaactaaagaaaagagatgctgacatttgtgattaaatagaataattgcactatttaagattaatcacttgagcctcggaggtggaggctgtagtgagtcatcatggtgccacggcattccagcctgcatgacagagagagactctgtcttagggaagaaaaaaaaagattaaggtggtccagaatgcacccaagcataaaatgcaaagatgatcttgccccatgtatattttagcatactacttaggtactgtttattttttaattatctcctttttacattttgacaattttaccccagtggtcaagccttgtattagaaaagacagaaagaaggaaaagaaagaaggcaggaaggaaggcaaggggaaagaaggggaaggaaaggaagtggaagggaaggggaagagaaggggaagagaaggggaagggaaggggaagggaaggggaggggaaggggaggggaaggggaggggaaggggaggggaggggaaacatgttgctttggacagaataaatgggtaagggtttctattttaattagattaagattaattagattaaacctctgaggaagtcttacttgagctgagaaactaaatatgagagggaggagtaccactgcattggttatagatggggtagaagtctacaaaagagttcattgaggaatagaatagtaaataagtgacttaataatgagtttgttgccgggcgcagtggctcaagcgtgtaatcccagcactttgggaggccgaggcgggcggatcacgaggtcaggggatcaagaccatcctggctaacacggtgaaaccccgtctctactaaacaaaatacaaaaatttagccgggcatggtggcgggagcctgcagtcccagctagtcgggaggctgaggcaggagaacggcgtgaacccgggaggcggaggttgagtgagccaagatcgcgccactacactccagcctgggcaatagagcgagactctgtctccaaaaaaaaaaaaaaaaataataataataataatgagtttgtattgttcttattttgcaaaagaatgcaagatctgggtagagaaaaggcaagagggaggacttcccagattgaatcaataatattaacagtatcaatctgccactaataattatttaagaaaagtatttttctttcagttttatttattaaatagtttctactagcctaatgttaaagtctgccaactagtaccttcaagttaatcacattcacttttgattccctcttaacacattaagatattttataactctgtgagtttaaaatctgatgcaaattcattgtggtcaggcaagatgcaagaccagtcaggcaaatacacttcccttattttttatgggtctgaaatatcttttgtcttgggagatgtattattatacaaaagatctatttggcaatttatagtttgctttttatctattcaattgttccctggtattcttagaacagaaaagcgaaccttttaagaataataacatgccaattacctttaattactctccagctctttcagttaaacaaaaaaaccctctcattttaggtttagtttgtaactgaatagaacattttatatctaaacccttaatggaaaggctttcctatttcccacaattttcttttctatttaatgtattctctaaatttaatacattatttaaaatgccatccatatacctgatcaacttgaaaagatggagaaacacacaagtaaagtttgttatctgttcacattttattctgtttccattttcataatcaaataaatgtagactgtaaaatacttatttacaaatctgtctgatttatataataaactctgaggaaactggaatgaagcagtgctacaagcaagggacagaataaagttttgtgtattaattacctgatttatactttagtccctttaagtaaaagaacgtaacaaatagaaggatagttattaatatatttggaggagaaagaaagataaaatgaaagatacaatgttcttaaaaactgagagttttatcttttttcagaagtctaaaaaatatttaaacatcttcctttatgttagcgcatatttatgttatacatttcatttacaagtaattgtatggtaaatagttacaaaaacaacaaggaaaagctttgagttaaggagctcatgattttcagtgtaaaatacatgttatttgagtaatttgggaaactgacagaagctttcttgcagtcaagaatgctgctcaaaaattaattttaaaataaaaataaaagaaaaaaaatcctgaaagcttatgtagcaaaacaagtattgtagtccattacaaaaattagccttttctgaaatcatgttaaaaagcaaaaagatcttagagcagaatttcatgtacagttcattttgggactgatcttacttccttggtaggtggtcttacttcatcctgttggagcccatcatggagagctgttttacaaatattcttagctctactacccacataaaaattcaacctatgactcctgtttctgataaagtagctatttaaattcattaagaatgtttcatcattttagtatgcaaaatgcattgttagattatgtaagtgacacatgctatcttaaaagttaataaatctcccagaagaaattagactcagatgctatatttattatggagaattaagaaatacctaaggttactgtgatcatcacttaggagttttgaatcaattatatgagaaactaaagaagaaactttgaccggaaaaaaaatgaaccaacaagaaaaaaattatataaagtcattttattggacacaaatgctaaaaattagaaaaaccatacattttactctatcaatctgttaggaaaaactatagaatatgatagtgattgcattgattctgcttagcaaattaaatgcaaaactaagatattcaccaaatataaaatatagttattttctaagaaataaaactcacacaactgccatttttagcagaatggtggcaactgccatttttagcagaaaccaaaactatttcctgttaacaagaaggaaaaaccatcagtgaacactcaagtaataatcaggggactaggatggactctcagtaagaaaccactggaatatacctggactaaatctattctaacaaaattaagtataccaaccgaatagttttgtgtgtgcatttgtttttactatatacttttataatctcaaaagtacctaaaaggaggcaaaacaagaaaggatttgtctacagaaagtaaaaataagaatgattataaaatattgttaaagaaaagacactgcacagaatagtcatggagatttctgtactaatcaccttgatcataatgaataatcactgaatttcactggcctattttcctccacaagattctatgttaggtaagcaactttgggtaattcaataataggaaagatgtttcttttataacatatctgatttgtacaactaattgaaatacattttatgctataaaataaaaatggtaactcttatttacacagctatttattgtgaatttgtataaagacagctcatccttagaacataatagactaggattcttggtaaagtatatattgtatatctgaaaaatgtaatagtgacaatattaaagtgttgccacttagtgctgtgttacctaaagtgtgtgacgctttctgtcagtcttatcactgacatttaaatttcagatataggtgaattcaatattgaagtgaatagagctaccgacatttgctttcctaatattcatggaagttgttgttgacctctcatagataaataagcaaataatatcttcaaaaatatatctaacttgactcaaatacttctaagtattttgtcatttgaagggatatgagcaagttgagaagaagaaatgtggagagagaaatattcatgaaaactaaatttataacattcaactattgctcaattcttagaaatttaatcactacttatattttaaagcaaaatatttttgaacttatttagaaaaatatgacttcatctctcatatgtccattcaaagttttaaacaaagtataaaaggaaattaaacagtggaggaaatgagaaaggtcacaggcattcaagaggtttcaacaaatttctggaggaatgaaaggtaattgaaggatgtgttaaaataatttctattattatctttatagatttagtgtccagtaaaccttttataaacaatccaacttgctgttttgtgttcttgaactttatttaaactgaattatattgtacatatccttttgtgacttaatcataccactgcatattaagtttgtgagagtaagccacattaacatatctaaataaagttatctattttttttctaaagtgtagtattccactgtatgaatctaccacattctactgttgtttaacttttgcattgcttatagtacttaactgagcctgtaaatattttggattacatttcttaatggccaaccatgtacatacaaaataaggagtgaaagccaattgctgattagaatatatggtcatcttcaatattactgggtaatacaagactctttttaaaacggatataatttccatttccaggaaagcatatgaaattattattgctctatatgtttgccagaagtctgtcttgtcagaccgtttttggtcaatctcttgtataagtaataatgtacatataaaacattttcatttgcatttttgtgttaaaaataagttaaagtgattctaaataggtatggtggacacttacattgtacattttataaagcacatgtgcaagccattttctttgttttactgtcgggttttctgtaatttttgcctggctttacatttaaatattgattgccaaggaattgattgttaaatattatataaggtaaagaatcactttaattattttccatatgtatagccagctttctcactctcatttattggcaaatttatttttcaccactgatctataatactagctttcttacatatcatgggttcttatattttccttactgtagtctacctattccatttcattgattatttattactttgttaataccacattgcattaattcttatatttcctgtaatatatttttccttcctcaataaattattaactgaattttaatatttttagagtttacataaattctagaattagcttgtcaatatctaaatcaaaccttactgggttttactttggatgcactagttacaaagattaattttggggagaagtgatttcattaaagtctttcaattcaagaatatatttatgtcaatgttatgtctatgtttatttgaactttatttaaactgagttatactgtacgtattcttttgtgacttaatcatgccactaaatactatgtttgtgagagtaagccacattgacacatctaaataaagttctctacttatttgaaatgcatttcaatattgcataatacgtttgtgtcaaagcatcttgctaaaagctcatattcattagtataatgtatcttagaatcattttgaattttctgtgtacttagtgtcatcggtaacatagtaatctgttttctctttcataattcttatttttttaatatttacaatcctatcccagtgtctaagacctgcaaaaggataaataaaattgcttgtaccatctatgtttattttgttcccaatcacaaaggaaatatttgaacattccattgttaagtgttataatttcaatagaacttttgaaaacaaatgttatcagttaaactagattctcttttaatttcgggttgttaaaatgtatgactttttaagaaaataaaattaaatatgcttataatattgttaagttatttgttgtggtgtatcatattaattgatacctttacatgaggccattattgcttcccagggtttcttagaataaacattggctgtgatgtcttacattttaatgcattgcttatttctgcatggaacttttttaagttttccttcaatattttcataaattacattggtgtttaatttactttccctttactatccttgtcaggttataatatcagagtcataatagcataataaaataaaatagagtatgttctttcctgtttcatgctcagaaagaattgtatgtaagattggaattattgttttgtttcatgtttgaaacaacttgccagtaaagtcatcatggcttgaaattatctttatgatatgatttctgactactgattacatgcatttgttgtagcacaattcagatttttcttttcactttaggttacttttggaaaaatgcatgtttcaagtaattgtacacattttacatatatttccaaatttattgaattaaacgttttcatactatactaatttaacttcttgatatttgtattatttataacaaaactcaataaactgtggcaaataagccagacagtatttataaataaagtattactggaacactgtcatgctcattcattgacatactgtcaatttatgccacaacaatagaattgattagttgcaacaaaccatatagcccaaaaacctaaaataattaccaacagatcctttccaaaaaacaaaaaaaattcttgacacctgatgtataattatttcctattttgattcctgagatggcatacttgtttcttctcttaattttatcaagccatttctccagagttttgttattgtatggctcctacaacaactaacaaacttttggccatatttcttgacttttctttccctgtattcttaatcactatgcatgtatttattatttccttttatttctgttgatatttctaacttctaccaataaattcaaaacattttaaaaattaatttgttgtcctcataaaataagaatttaaggttctacattttcctctaaaatgacacattttataatgtagtatacattttttaattaaaaatattttataatttccattatgatttgctcttgggtgttgagttactaagaagtatatttctgaggtttttcttcaatatgactgactatagatatttgactctagttattctcagaaagagaaagcaaagttatggataaataatcgttaattccaatatctatatagacggaagtgtgctagagcaccacaagaagaaatttgaacacagaaaaataaggaagcaagaacccagcagacattatactctgagggacttgatgttccatggaaaagcataggtgggggtgtcttttgctcttctcacctctgcggcagactgcttgtttctgaactgttggagagccctccattctcacaagcccaagcactggtgtgggccgcaatcttggaacaaattgaggacagagaacaaggctactatttcctgcagtgccacttgcccttcacccagccccaagatgaggtggtgggcaccatactggatatgcctctgtggtggacttctatactgcctttgagtgagagagaggcttgccccatccccttgccggcttccttctccgtccctgcgtcgagctgtggctagatttctccatgagggcagagggcagggcaagaggcgtgagaagcatcttctggaaggtctgcgggcaccctcctgcgggtggacaatgagcgcctgggaggccgttgtccttggttggggagcggtcgtctggatctagcctagcaaagaggctgctccggatggggaggaaatgaaaacccctgcagctccgacgcagatgcccacgttgcccaggccttcacagacccccaagccggaaccgccgggaaaacgattgccaaccggccacaacacccaggcagagacgcggggagaggctgaccagaagaaaggccgacgtgcaagaaacccagcctccggcgcacagggaacatgtgtcccaaggcgcacgcacacacagacggacagagacagaaagagagggcgacggaaagagcgagaagggagagagggagagagagagagagagacttaagagagagacggtagtgggcacacagacacgcacgcgcgcgcgcgcgcgcacacacacgcagacacacacacacacacacacacccataacggacacagacatacagcaggtaacacccacccccaggcagcccctgaagctgccgggttctggtctccgcgactacgagccaccggtgagacagcagcccacgcgcacacagggagacctgtcctcgacatcacaagggcgccacttttggggagactcacccgcacaccgtccgcgcacgcctgaggctgggatcccgcgctgcctccccggcgatctgtctgagttttcttcctcctggggtttcttcctgctggtggaccctccgcgaatcccggcctccggagaccgtcctggtaactgccctggccagggctggtctcagccccgactctgacgcacgatcacacagggctcctacttcgccaagtctcaaggacccatccccgggcaatggtggcggtcactgtgaccaaagcggcggctcgggcctcgcgcatgcgcactggcgaggccgactcacccgccccacccccccttactcggcagagtcaggctgcggaccttttaaaaaatggcggcgacgcggcggctgcggggactggggcggcggtgctggaggttgcggcggcggctgcggcgcagcccggggcggcgggtgggaagaggactaccagaggggcctgcgggagacccagggtcggacccataggagtcctgtcgtcaggacctccttgatcggtcttctgcttgggttctcggtgaaggaggagcttcggggtgtcggctgggctgcgcggactcctcttgggatccgatgatggatcccacccggtgatcgggaatggggttacaatgcagtgaggcggaaaggctctcgccggggcacagaaagatccccagggccacaaggcgtgctgtcgcctgcaaaggcactgacccacgagcccactgcctccctccttcctgggtggagcaggggcctgccttcatctccaaggcccgggggctccggcatctcgacgcggcttccggcgacacgggcaaagagagacagaggctagtccgagccggagccagtgtgaccacacgtggcactgacgtcccccaagagcacatgcagtgagcctgtgtctctgaggccgtagtgggcgacgatgagacggacagtgatgtccaggcctgcgcccgggggccactggagacctgcccctcaaagcggaggaaacgccaagcgcacctgaaaacctgcgagacagggcctgtacacgagtccaatactcctacttcgccaagtctcagggacccatcccccagcaacggtggcggcgcagagaagagcacggcgccggcgcaggtgcagagagacaggaggctgatggggggaagttgaggcacctggggcagagaaaaaaatgcatcgccaagcggtttctgggtcatctactgacgaaaatgtcttcccatcagcccttgcgctggtccccagggaccctggcatccgtcgttggcgcccagggtgcgcgtcgggccactaggggtaccccaactcggacagaaggcccatgagttgaatttgaagtttgtgggaatagaggtgaggcaccaggggcagaaaaaaaacaggagacctcgcctcagacaagcggggcctgggtcccccatggatgaaagtgccttcccattatgctgtaccctgggcagagtggacagtgacgaccctggttcgagcccagggtgcgcttcgggaccgcttgcggtaccagaaagcgaacaaatggtccatgagcggaaggtgaggcacctgaagcagagaaagtaaagaaacgcgccgccgagaagcagtgcctgggtccctcacggaggaaattgtcttctccttagcccgttcgcttggcactgaggtccctggcgtccctggtttgatcccagggtacgcctcgggccactagtgttagcccaaggtgggcagaaagcccataaggggaaggcgaggcacctggggcagagaaaaaaaaaaacttcgctgcagagaagagcggcctgattccccacggacgaaagtgtcttcccatcagtccctgcactgggacccggggaccctggtgtccctggttcgagctcagggtgtgcctcagccgctacgtgcaccccaaggggagctttgggagcacaaagcccatgagggaaggtgagttttgagggaggagtggtgaggcacctgtcacagaaaaagaaaaaaaaacaacccgcgccacggagaagcagggcctgggtcccccacgatgaaaatgccttcccatcagctcctgctctgggccctgtggaccctggagaccctggttcaagccacgggtgggcctcgagcccgctaggggtacccccgtgcgcctctctgcgcctgcgccggcgccctgtgcctttgcgagggcggagctgccttctcctcagcacagacccggagagcattgccagggcggagctgagttctcctctgcacagacttcggagatacagcgaagcggagcatgttctcctcagcacagacccgggcgggcgggccaggggcaccgcgagggcggagctgcgttctgctcagcacacacccgggagacaccgcgaaggcagagcagcgttctcagcacagaccttgtgggcactgcctcgctttgggactactcggagccgcatcaatggtgaataaaatccttcctgtttgcagcccttaataatcagggtcagagaccagttagaagggttcagtgtggaaaacgggaaaccaaaagcccctctgaatcctacccaccgaggttctccccagccaaggcgaggcggccgcagtgcgagatccacaccgcagcctcggaagacaagcgggcagaaatcccatgaggggcagttgaggtttgaggaaggcgaggtgaggcacctgtggcagaaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgatgcacctggggcagagaaaaaaaaaaaaaaaaaaaccgcgccgcctataagcggggcctggctcccccacagaagaaactgtcctcacatcagcgcttgcgctgcgccccagggaccctggtatccctggctcgagcccagcgtgcgcctcggcctgctaggggtaccccaaggcagacagaaggcccatgagggaaaggtgagacacctggggcagagaaaaaaataaaaaaactgcgccgcccagaagtggggcctgggtcccccacagacgaacgtccctacccatcagccctgaactgggccccggagaccctagcgtccctggctcgaaaccagggtgagcttcgggcccgctagtggtacctcaaggcgggcagaaagcccatgaggggaaggtgaggcacctggggaaaagcgaaaaaaacaaaaacaaaaacgtcgcagagaagcagagcctgggtccccgaggaagaaagtgtcttcgcatcagcccttgcgctgggcctcggggaccctggtgtcccagtttcgaacccagggtgtgcgtctggccactaggggtaccccaagtcggacagacggcccatgaggggaaggtgaggtttgagggaggagacgtgaggcaactgtggcaggaaaaaaaaaaaaaaaaaaaacacgccgcggagaagcggggcctgggtccccaacggacgaaagtgacttcccatcagcccctgcgctgggccccatggacactggcgaccctggttagagcccagggtgcgcctcgtgcccaataggggtatcccaaagcgggcagaatgctcattaggggaaggtgagacacctggggcagagaaaaaaaaaaaccgcgccgcaaagaagcgggacctgggtcccccacggatgaaagtgtcttcccatcagcccctgccctgggccccatggaccctggcaaccctggttcgagccccaggtgtgcttcgcgcccgctagggttacccagaagccggcagaaggcccatgagaggaaggtaagacacctggggcaaaggaaaaaaaaaaccgcgcttgcagaaaagcggggcctggctcctccacggacgaaggtgccttcccatcagcccctgcgctgggccctggggaacctggtgtccctggctggaaaccagggtgcaccttggacccgctaggggtaccccaaggagagcagaaagcccatgaggggaaggtgaggcacctgcggcagagaaagaagaaaaaccgcgcagcggagaagcggggcctgggtcccccactgacgaaagtgtctttccgtcagcccttgagctgggtcccgaggacgctgacatccctggttcgagcccacgctgcgcctcaggctgctacgagtaccccaaggaggaaagaaggcccaaaagtttcagctgaggtttgaggcaggagagatgaggcacctgtggcagaaaaaaaaaaaaaaaaaaaaaaaaacgcgcagcggagaactggtgcctgggtctcccagggacgaaagtgccttcccatcagccactgcgcttggccccatggaacctggcctccatggttcgagcccagggtgcgcctcgggccgctaggggtaccccaaagtgtgcagaaggcccatgaggggaaggtgaggcacctggggcagagaaaaaaaacaacaaaaaacctcgccgcggagaagcggggactgggtccccccaacggacgaaagtgtcttcccatcagcccttgcgctgggccacagggaccctggcttccctggttcgagcccacagtgcacctcgggccgctaggtgtaccccaaggcagacagaaggcccatgaggggaaggtgaggtttgagggaggagcggtgaggcacctgtggcagaaaaaaaaaacgccccacggagaagcagggcatgggtcccccacggacgaaggtgccttcccatcaggccctgcgctgagccccgtggaccctggcgaccttggctcaaacccagggtgcgcctcgggccgttaggggtaccccgaggcgggcagaaagcccatgaggggaagttgaggtttgagggaggagaggtgaggcacctgtggcagacaaaaaaaaaaaaaaaaaaaaaaaaccgcaccgcagagaagcggggcctgggtccgccacggacgaaagtgtcttcccatcagcccttgcgctgcgccccggggaccctgacgaccctgattcgagccgagggtgcgcctcggtccactaggggtaccccaaagcaggcagatggctcatgaggggaaggtgaggtacctggggcagccaaaagaaaaaaaaaactgcgccgcggagaagcggtgcctgggtcccccacggacgaaagtgtcttcctatcagcccttgcactgggccccgggaaccctggcgtccctggttcgaccccatggttcgcctcgggccgctaggggtaccccaaggtgggcagaaggcccatgaggcgaaggtgaggtttgagggaggagaggtgaggcacctatggcagaaaaaataaaaacgcgccacggagaaggggggcctgggtcccccacggacgaaagtgctttaccattagcccctgcgcttggccccgtgcaccctggcgaccctggttcgaacccagtgtgcgcctcgggccgctagccgtaccccaaagtgggcagaagcccatgaggggaaggtgaggcacctggggcggagaaaaaaggaaaaaacctcgccacggagaagggaggcctgggttccccacgaaagaaagtgccttcccatcagacccggtgctaggccccagggaccctggcatccctggttcgagcccagggtgcgccttgggccgctgggggtaccccaaggcggacagaaagcccatgaggggaaggtgaggcacctgtggcagaaaaaaaaaaaaaccgcgccgcagtgaagctgggcctgtgtcccccactgacgaaagtgccttcccatcaggccttgcgctggacctcgcggacactggggaccctggttcgagcccagggtgcgccttgggcccgctaggggtacccagaagcgggcagaaggcccatgaggggtaggtgaggcacctgaggcagagaaaaaaaaaaactgtgccgcggagaagcggggcctgggtaccccacggaagaaagtgtcttcccatcagcccctgagctgggcccaggggaccctggcatccctggttcaagaccagggtgcgcttcgggcctcttggggtaccccatggcgggcagaaagcctatgaggggaaggtgaggtttgagggaggagaggtatggcacctgtggcataaaagaaaaaaaaaaccgcgccacacccttgcgctgagccccagggaccctggcacccctggttcgagtccagtgtgttcctagggcggctaggggtaccgcaagtcggacagaaggcccatgaggggaagtgaggtttcaggaagtagaggtgaggcacctgtggcaggtgtccatctgtaaactgtttatccatgtgagccctgatgtccaccaggggctggatgtccccctggggctagatgttcgcctggagcctggtgcccacctggggcctgatatccacgagaggcttagttatccacctatggccatctggagccagaggcccacctgaggtctggtgtacacctaaggcctgatctctacctggggcttgggtgttcatgtggggcctgatgtccacctaagaccatgtgttcacctggagcctgggtgaccatctgggttatgatgttcagctggggcccagagttcagctggggactgggtcaaccttctgcctgatgcacacctggggactaggtacccacctgggctccagtgttcactggggcctgctatctacctggggccttgtatttacctaggaccagtgcatccatctggggtctgagtgccctcatggagcctggagttttcctggggactggggtctgccttaggcttaagtgtacatctgtggcctcgtgtccaccttgggacagatgtccacctggggacggatattcagtaggggcctgagtgtccacctggtttgtgatgtctacctggggcctggtgttcatctgaggtgtgatacccacctggggcctggacatttgcctggaacctgatgtacagctggtgcctgaagttcatctatgcctggtgtctccctggggccaggtagtcaacacagggcctgaagaccttctagagttcagtgttcacctggggtccgaagtccacctagggcttgggtgtccaaatagggcctggtgtcagcttgagatttgtgtatttacctagggcctggttgtccacttggggcttgattttttacttggtttttgtgttaatctggggtctagtgtccacctggggcctgggtatccacctagggactattgtccagctggagactaatgactacctatggcctggtaatcacctaaggctttgtttcacttaggtacttggtgccaaactgttgcctgctgttcacctggggtatggtgtccacctggggtctggatgtcagcctggggcttgttgtatacctgtatcttagatatccagataagggtctgttttctgcttaggtgcagcagtccatctggtgcttgagtgtcaacctaaggcttgatgtctatgttggacctagggttcacctgaggcctgatatccacctggggcctcaatgtccaaatggggcctgatgcccatctgggccctgggtgtccacctgcagcatggatgtccactgatactttatgtccaccaggggcctaatgtccacctaaaacctggagttcacctggggtctgatgttcagctgaagaccggatgtccacctggagccgaggaatccacccagggactggtgttgaactggggcctgatgaccacccggggacaaggtacacaccaggcttgatgtccacctgtcaccagatgtccacctgagtcctgatgtccatcttgatcctgagtgtccacattgggcctgatgtccagctggggcctagatacccactgggggcttcctgttaacctggggactggtgtcattctggggcctaatgaccacctgggttgtattattcacctagggcctggtgtccacttggggcttgagtgtaaccttggacctggcacccacataggattgggtatcagactggccccttggtgtccagttaagacatcatgtgaacctggctcctgagtgtccacttggggccaaatgactactgggggcctgaatgtcaacctagaatctgaggtttactaggggcctaggtatccacctggggcctaatgtccacccgagcctgggtgtcaacctggggcctgatgtaaacctctagttcagtatccacctggggccagatgtcttcctagagacttatattcacttttgacctgatgtccacctggggacttgctatccatccatggtctgatattcacctggagacagatgttcaactgtggccagaagtgctcctggggtctgggcttccacctggagcctgatgtttagctggggctagagttcacatggagaatgatgtccacctgaagtttgatgtttacctggggcctgatacctacctggtgcccaagtattctcatgtgcctaacgtccactagttggcctggtgttcatctgagggcttggtgtcaaccagtggctttatgtacacctggattctagtgtcctcctggggtcttatgcctaccaggagtctggtgtacctctggggtctagtatccacctggagtctgggcgtccacctggagcctaatgttgaggttagactgagtgtcagcctgaggcctgatgtctactagggcataggtattcacctggggcttgttgtttacctggggactaatgtcaaccttgagcctaggtatccacctggggaatagtgtccagttgcagccagatgtccacctatggcctgaagcatggttgttatcctaaggccttgtattagtccattttcacagttataaaaaactacctgatattgggcaacttatgaggaaaagaggtttaactgacccacagttcttcaggcttaatagggagcatgactgggcgggctcaggacacttacaatcatgatgtaaagccaagaggaagcaagccctttttaccatgtgggaggaggagggagacagaatggggatgtgctacacactttcaaataaccaggtctcgtaagaactctatcacgagaacaccaagtgggaagtctgcccccatgattcaatcaccattcaccaggcccattcttcaacccgtggggattacaattcaacatgagatttgggtggagacatagagccaatatcaggcctgatgcccgcctggagtcatgtctacctgaggccttatgtagacatgaggcctgggcattcacctaggacctcatgttaagataggggctggagttcttttggtgcctagtgtatacctggggcccagatgtataactagagcctgatgtttcagatggaaacctgggccccaggtgctcatcagatcccaggtgaaaactcaggcttcaggtgcacatcagactccaagtggacacataggccctaggttgataccaagatttcaggtagactctgggtcccagaaaaacaccctgccctaggtggacagctgaacctgagtagacatcaggccccagattgacatctggcctcaggtagattccttggcccaaggtgaatactcagtctccagccctaggggaattcagtcttaggtgattaaggactggcgttcctctggggcctcatgtctacctgggccctgggagtgcacatggagccagatgtctataaagggcctgagtgtccactagggcctgaggttcaccaggagcatagacatccacctaggacctcatgtccacctaaaacctggtgttcacctggggcctgggtgacaacctgggatctgatgttcacctgaggcccagagttcagctggtgcctatgtcagcctggcacctgatgcacacaagaggactaggtgcccacctgaggactggtgttcatggggaactggtgttcagctgtggcttgatgagcaactgggtcctggtgtcctcctggcaactgatgtccacctgggactgcatgcttacctagggcctggtgttcccctggggcctggtgtgcccctgagatctgggtccacctgggcctagtatccacttggggcctcatatccatctggaacatcatgtccacttggggccttgtagttacctagggactgggtgtccttctggcacttgagtgtcctcctggggcctggggttctcctggggcctgggtgtacatctctggcctgatgtccaccttgggtggatgtccacctggggacagatgttcgcttgtggcttgagtgtccatctcgtgtctaatgtctacctggggcctggtgtttgcctgaggccttatatccacctggggcctgggcatccatttgaggcctgatgtctacctaagacccggtgtttaactggggcacagatttcttcctggagcccgacgttcatctggagcctgaagttcacctgtgcctgttgtctacctgaggcctatgtgtcaacctagggcctgatgaccaccctgagttcagtgttcacctggggcctgacatctgcctggagtctgggtgtccacatagggcctgatgttggcttgggaccaaagtatttacctagggcctgggtgtctacttacagcctgacttctacatggttcattgtgtcaacctggggcctgatgtccacttagggcctaggtaagctccttatgactaaagtccacatgggggctgaaaccatctcagaccttgaacctagggcttagtgtcgacctgagacctggtgaccccctggggtcaaggtatccaccttgggcctgatgaccaactggggtttaaggatctacctagagactggtgtcaacctggaacctgatgtccacttggggtctggtgtacaccttgggcctgatgcccaccttggcacaggtgtacactttgggcctagtgtgcacctgaagcctggctgtcaacctgggtcttgatgcacacctttagtcaagtgttaaactggggcctgatgaaatactggagcctgatttacacctgtgtactgggtctccacctggggcctgatgtccacctgcagccagatatccacctggcaccagatgtctttgaggaatctgggtgtccaccttgaaaatgatgtattccaagagactaggcatgcacattgggcctggggtccacctgggtcctgatgtctacctgaggctggtattgaactggggcctgtgtgttcacttggagcctgatgttcatttggaacctggtgttcacctaggacatgggtatccacctggatcctgattttcaagtggggagtggatatagacctgggaactgatggccacctatgctataagtaacccaaccacctggggcctggtgttcacctgtggcctgatatccacctggtacctgtgtgtcaatctagtgcctggtgtccacttgaggactaggcagacacctggggcctggtgttcatcttgcacccagtgtccacctggaccctgtgtatcaacctgtggcctaggtggccacttggagctttacgtgcacctggggcctgagaggttcctaggatctgatgaccactggggcccaggtatccacctgggatatcaggcttcaagtgtacacccaggctccatgtggacaccaggccaggagaacgccagcccttatctgaacatcaggtcctagatggactcccaggctccatgtgtacatcaggccccaggtatacacgggactccaggtggacaccagcactcaattggatacacaccctgaaggtggataccaggccccacgtgaattcctacactccaggtgaacatcaggtcccaagtggatacctggaccccaggtggataccagtctctaaattaataccaggcctcagatggtccttaggagccatgtgggcattcgtcatcaggaagttacctaggcccaaagtggacatcaggccccatgttgacacaagatctagttggaagtcaggcaccaggtggacacccaggccctaggtaaatacttaggtcccaagttgacagcaggccctatgtgaacactcagaactcaggtggacatcaggcctcaggtggacatctgagttcatctggaacctcgtgttacaggccccatgtaaacaccaggccttaggtggatacccaatctctaggtggacatcagagctcagattgacacaaagactccagtagacataatgtaccaatgaatatccaggcacccggtaaatacccaggccccagattgacaccacggtctatgtggacacacaggccccgggtagtaaacaggcccaaggtggacactggactggacatcaggtcctaggttgacaaccatgctccaagttgacaccaggccccaagcgaacatctggccccagctggacactagtcccctggtgaatacctagtctcaaggttgacatcagaccctatgtgaacactagaccccagataaacacttataccctaagtggacatcaggcctcaggtggttacccagtcccaaggtgaacatcaggaccccgatggcaccagttatcaagtggattcctaggccccaggtgaatatcaagccctaggtggataccgagccccaggtggatacctggatcctggtagacatcaggtcccaagaggacactagaacccaggagtacattaggccacaggttaacacgaaggccccagatgaataccaggccaacttgtggacatcaggcctgagaagggtcctgtggacatcaggcctgagaagggtccaggtggatatcaggccccaggtgaacatccagcactcagatgaacattaagcttcaggtaggcatcatgcctcaggtgaactccaggccccagctgaacatcaggccccaggtggatgcccagaatccgggtgcacatctggccacagttggacattcaaccccaggtgaccatcaggccatgggtgaatacacggtttccaggtagacatcagatcaaaggggaacatcagtcccccagtggacatcaggcccaaggtggacactcaactagaggtttacatcaggccacatgttgacacctagtcccaggtggacatcaggccccagctagatagatacctagtcttccagtgaatttcagacaccaggttgacattcaggcccccagtggtcatctggcctcatgcgaacactcagaccccaggtgcaaatgatgtctcaactggataccaaaccccttgtttgataaccaaggcccaggtggacaccatgtccaaggctgacactcaagccctaagtgaataccaaactctaggtgaataattcaacccaggtggtctttaggactcagctggataccagtccccaggttaacacaaggcccccagtgggcacctaggcaccagctggacatcaggccctatgtaaatacccgggtctcaggtgaacaccatgccccaggtggacatcaggcactaggtgaacacggggccacaggtggacatctagcccctgggcaacatccagccccaggcggacataaccatttccatggataaaccattcccaggtggatatcaggcctcaagaggatggcagtcaccaggtagacatcaggcctcagatagacaccaaggtcccagatgtacagcaggccccaactgaaccccagactcatgtggacatcaggccacaggtagacaccaagccttaggtagatacctaacttcaggtagtcatcagacccaaggtggacacccagtccccaggtggacagtcaggccccaggcacacatcaggccttaagtggacacccaggccccaggttgatatccagttcccaggcgatcaccaagccccaggtagacaccaggccgtaggtgagcaacaggatgcagtaggtcatcaggccacagctggataccagtccccggtgatcacaaggccccagtgggacatagatctaaggcagacatcaggccccaggtggacatacagatctgaggtggaattcaccctgagggggacattcggccccaggtacgcatcaggcctcagctgaataaccagtccccaggtggacattaacccacaggtcaaccacagtccccaggttgatatctggtccccaggtggctactcaatctgcagggtaacattaggcccctgtaggatcccaggccccaagtggattcctaggcccctggtgaacatcaggtgcaggtgtccaagtaggccctgggtggacataactgtgtacaggtaaggagttgacctgtggggaggatgagcagtcagcagcccactggggtcctgagtaggtcttctggaaggaggaggctgaggggatggaaccttaaagaagcaacctcacttccttggcaacagaccctaacagaacttagaattctggtaaccaggccaggcacggtggctcacacctgtaatcccagcactttgggaggctgaggcaggaggatcatgaaaccaggagatcgagaccagcctgaacaacatggtaaaaccacatgtctactaaaaatgcaaaaaacaaacaaggtcaggagatcgagaccatcctggctaacacagtgaaaccccgtctctactaaaaatgcaaaaattagccaggcgtagtggtgggcgcctatagtcccagctactcgggagtctgaggcaggagaaaggcatgaacccaggacacggagcttgcagtgagcccagatcacgccactgcagtccatccagcctgggtgacagagcgagactctgtctcaaaacaaacaaacaaacaaaaaacaaacacaaaaaaactagccaggtgttgtggtgcgtgtctcgtgcctgtaatcccagctactcaggagactgaggcaggagaattgattgaacccaataggcggaagttgcagcgagccgagatcatgccactgcactccaccctggccaacagaatgagacaatgtctcaaaaaaaaaaaaaaaaaaaaaaaagaatcccgataaccaggcaccaggcacccacatcctagagttagacccatagccagctcacttggtgggagatgctcaagagagcaagatgttcttgtgctgcatccccacatctcaagtctcctgcttcaggaatggcaggagtgagagcctttcttttccaacgatgcccttgtaggctcatccctcaccccagatgtctctggccatttgacagaaggcccccccaggtaccacaggacaggagtcaccaggtagacatcaggccccagatggagctaccaggccaggcctcaccagtgatcccaccagggccacatctgcacattgtccttgtccagctggagcctctggagctcattgagacacaggcacatggtgaggtcacctgcagtctggaagtctttccagggacaatgttttcaggctgaaattcctttaaattcagtgaggttgttttcatgtttggaaattccagtggaaagtgagtgatattggtgacctctctcctttttcagctcctgcttcaggtgcagaaacacagctatttccagtgccagctgttgagccagtgccagcaccaggggcagagccccttccagggacagcgctggagctagaggaacctccagagccttcctgccgctgccctgggactgcacaggaccagcccagtgagaagctgcctgacttcatggcacctcctgtagagccaccggcctcagccctggagctgaaagtgtggctggagctagaggtggcagagagggggtgaccagcacagctccagccagcagctcccacactgctcccagtcctgggcacagtggaagctatggaggcagagaccagggtgtgcaacctgggctcctctgcctcactggagagggacttctctcattcagcagagcagcagccctgctgctgaaggccctgctgctactgctgctgggggtgtttgcctgcctgcaggaggtgctggagagcaagaaaaggagcctgtgagcaggggttccagcaggtcctccggctcccagaggtgacctcctcctccaggaatggaggtttgccctcagctgggcatctgggccatttgcctctaatgtgctgcccaggatggcctcttcttgacaggtggacaggggttgagggggccagggggcatctccaaaggaagctcttaaactcagcagcagcactccagaatctccatgcctgcacctgcccaaggatttattcatagcttaactaagaatttcaaatttctaccataacactgaaataaagtttgactttttgaaacttctatgacttctttcactccctaatattgtagatggtggttttgaggtgacgttgaaaacctctgatagttgtgtgttttgttgtggttctttgggtgactaaattaccatctgatcaagtgatattgaaaacccttcaggtatggcttttagaagactttgacctatttttgcttgtgttgactctccctccagctttgtggaaagagggatcatgtaggttcaattctcaggcagatcagtcaccttttgccatcaaagttttagcatccatttcgaaaatttggtgtacaagttgatattttggtgtttttagctaatctggggtcaaaacagaatgccatagatgaggaagcttataaacaaatttgtttctctcagttctggagatggcaaaattcaaggtcaagtggttagcagattctgtgtctggtgtgggcttgctttgtggttcatagccatgtttctaccatgtcctcacatgacagaagagatgagggagctctctatggtgccttcaataggggctactaatcccactcttgtggtccctgccttcatgatctaatcattccccaaggccctacctccaaatatcatcacatagggaattagatttcaacacttgaatttgagagggacaataacatttggtctatagcatcaggttacccagagccttatgcattcggaggaaatccaaaatcttctgtaagtatttgctggtcccctctgggcttagggaaatctttaattgcagctcttgattcagcttggtccaagccgaaattctacgtttgcctgggtaacttgttcatgggacagagggaagtatagaggcaactgaccatttggagttttaggacaattgatggaagagggcttggcatctggatgagaagtggagggagaatagaacaaaggcacagaaggagagagcacagtgagaaaggggaagagggacatctggacataagggccaactggagggcagggaaggtaattttccttgcattttaaactcagaccacatatcacatcagaatcacctcagggagacgttttcaatgcatattcctgggtttcttctcttggaattttttattaaatcttgagttgtgctgatttatccatatttatcataagaattttggataattcttactttgagaggcccaggcagtggatcacttgaggtcaggaattcaaaaccagcctggccaacatggtgaaacctcatctctactaaaaatacaaaaattagccaggcatggtggtacatgcctgtagtcccagctacttgggaggctgaggcaggagaatcacttgaatcagggaggcagagatgacagtgagctgagatcacaccactgcactccagcctgggcaacagtaagactccatctcaaaaaaaaaaaaaaaaaaaaaaaaagaattgtggataattctgatgcaattagaaaacaaagcagagcttgacaaccactgggttgggacgtatatcaggaagacatttgattatgtaaaataactgcaaaacaaactgaaggggaattattttaaaatgcttgaatataattatataattcaactcttcttatgtatgtagtttgaccacatatttgatgtctgctatactaagattggaaatgtgtagaagtttttttaaaaaatcaggtagaagcacagaaaaaaggagttggagagaaaagaaaactagctattgtctggtaacaagagaagagaagggaaacgaagtagcatatttttgttcattgatggcatctaaattatgatcccaaatatttttttcctaagaaatccaataatacaagtattcagagtggagtaccaacactgatttactgggaaagagaagtgtactctgttttgctacacaatgttgagggagaaggaaaggaaaattatttgagtaaacaagtaagagactggtcctcagggaagctgtctgcctgaaaaatcacaactactgcacctacagataagccctgaacagataagcatgcagggtccagcacagatgccttctgttctttgtgtatttggcaagctcccaggtaaaattttcctccctttttcaggcatatacttggcggtctctgtgggaacttgcgcagggaggaggggggcttacctaaaacaaacccacagttacagaaacaagagaagcccactttgtgcttgactagagacatacccacagctggatatataaagggaattgtgccgacagttttatatatagctgagaggagtttcttataaaagctttttgattcaactgtaaaaacggcaatccacttggacgcccttgtctgctgcagagagcttcctccttttgcttgttaaactttcactcccacctcacttgtgtgtccccgtcccttaatcatcttggtggtgagatgaagaacgccaggtgatacctcacaagagagactgctacgttgtggtgcattggcgagactgcaactttaagaagtgtgacttttattgctgctgaattattttatctcctacccaattgaaaataaaggatataaagtgcttaggttgaacacaaagtcctctgctctaggtaacatcttcagcagccacattagcagaggcatgggtggtaatggtggagtagatgtctctttgcttctgacagggtgtctgcttatgtgttaaacaaaatagtatggtatatatttcattaagaaatctgctaaaaaatgaagtaaaacaggttcatgttcttaagaggcacaggatttgctacggcagcaagaccaaaaggcttaagtaacaaaaatgtgcatagtagttacaaacattttcatctaaacaaaacaatgtgagcatctgcatatgacaataacttatgcaaaaaaatatttttaactgagattgaaatcattttatacataacaaatgttatcactgtattctcaggtaatatattgtttgtatatagatgttataaataataacttatttaagttattcatcatttatacaacaattaattctttggaatctacaaaatgctggttttgttctaggcactgaatgtacaaattgatttaaaatatgtgttcttagagtgtggtagattaaaaaatacaaaataggccgggcacagtggctcacacctgtaatcccagcactttgggagtccaaggtaggtggatcacctgaggtcaggagttcgagaccagcctgaccaacatggtgaaaccccatctctactaaaaatacaaaattagccgagggtggtggcacaagcctgtagtcccagctactcgggaggcagaggcaggacaatcgcttgaacccgggaggtggaggtggcagtgagccgagattgcaccattgcactccagcctgggcaacaagagcaaaactctgcctaatacatatacatatattatgcatagatacatatatacatatgtgtgtatatatatacatatgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacatatacatatgtgtgtatatataacatatatacatatgtgtgtatatataacatatatacatatgtgtgtatacatatatacgtaatatataatatatgcatatgtattatatacatatatacataatatataatatatgcatatgtattatatacatacatacataatatataatatatgcatatgtataatatacatatatatctgtctaatatatatacatatatacatatattaaatatatatacatatatacatatattaaatatatatacatatatacatatattaaatatatatacatatatacatatattaaatatgtatacacatatatgttagaagttgtactgctgaaaacaagagctaccaataaaaaaatttcaggaaacctagtgtgattatttttaatagaaatggatattttaatacaggtctcttgttttttcttgtggaaataaatgacaagatggaatttctgggtgtttggtatctgaatatttaagtatagcaggtatggtcagtttttcaaaggcattttaccatcttacttgtccatcggtaactcataagatatgtggaacaacgtcctctccaacaacctctagtatcagtctttgtaaagtttgtcaattaaatgggtgtttttttgtttttgtttttctttttgagaccgtctcaccctgtcacccaggctgtagtgctgctgcgtgatcttagctcactgcagtctttgccttccaggttcaagtgattctcctgccttggcctctcaagtaactgggactacaggtgccccccaacacacccagctaatttttatatgtttagtaaagacagggtttcaccatattggccaagctgttctcaatcctgacctcagatggtccacctgtctcagcctcctaaagcgctgggattacagtcatgagccaccgcacttggctggttttctctctctctctctctctctctctactttaagttctgggataaatgtgcagaacatgcagttttgttacacaggtatacatgtgtcatggtggtttgctgcaacatgggtgtaggttttgcaggtaattattatattattaaaagataacagaatacctagctaaaaaaaaatgcgaggaggcattgatgggcacatgtttactgagcacatcctgactccagaattaaaaatccaatttatgcctctgcagtccaataaaatttttccttaagaatccagggatcagactttcatctcagcaaccactccaatatggtttctcacctactcattccaacgagctgctcatatcaaaatataagtgctatccatattgttaaattataaattgaaccataacttctcagccttcatcttaatttatatatcagcagcatttcacacagtctatctccaccttctctttgtaaaacttttttatagaattccagaacacttaacttactttccccccaccacgtttttgaaaattacccctagtccttttttgcaggtttcatctttactatttttcaaatgttagaggaccattaggctcaggaatttcacttcttatctttcttatctttgctttcttactaatttttgtgtcattaatttcctgatatttcatattacacctaaacactggacactacacccaacactccctgacttatccacgtggatgtcagttaggaatctcaaaattaatatgtctgtatggagccactgaaactccccaaatttgctcttccccattctgtttaatggcaactcccattttatagtttctcagctcaatattcttggtgtccccttttaattctgtctctgtagctctgtcactctcttcctgtatctgtctgattctctccctctctctcctctctctcttgctcactctcactcttgctctctctccctgcttcacacacacacaaacacagacagacacacacacacacacacacacattttcagatctgatgtgtatggaattcctgccagctttacctttaaagtgtaataattccaaatgttgtttccaaattcacattcccacccccaccacttggtaactatagcgcttccctcacaaggccaagtgcagagatttcttggggaaataatgagaactattatacattcttatttcaaggacccttaaaattataggattaccatatttgatactaatttaagcttctgtcattgcccttttttaaatccagtctccacacagctaccacagtgtgcaagtagaagtctcagccatatcaccacactcctgctttaatgtccctactccattgctgcttttctccttcagaagagtttaagcttaatgaagctgggcaactttacatatttttccacgagctggagatcacttggtgtaaggtaaaaatgatcagtaaatattttcaaataacagaatccatgaataatagttttgtttctttgagagtacattaacttttaaaaatcaagaaaatagattggtcaagagaattctgcttgttttgattttgttatccctcgattagattaactgtgttagtataaatgtcagtgtggaaagctataagcatttcctaaactttaaaatgaaaggcatggaatttaaatatctgctccctttattcaaacaaccaaaaaacacaactttttaaatatattttatgtatgtatgaaatctaaatttatttttctctctttatccctgaatactttttaaaattattcatgtcctcattattttttaatccacttcagtcacattttaaaatatattttcgacttcattaagaatatctttgtgttccactgaatagattgccaaataataaaacattagcagtataatttcctcataaactttatttaatttgcttggttaaacatagatttcctactctcaactcataatttcattcaataagaagtataatatattctacttgacatttgcggggttttcataccatgcatttgtcattgaaattggtttttgatatttgaaccactagtttataattgtattgttagttagactggtctgtagaatctttcttcgttttgattctgtggtttattcattatggagtagctgtgctattgtaaattttgaggtcaaaagcttaaaacattttatgtattttcaaacaaagtggatggcatttaaatatctattccttaaaatttggaagaaaggttaacaccatataaacccagagcctgttttttagattagtagcacgtagacattttcaatttcttctaaagttgaaaaaaataaacattttatattcatagaatgcttgatgaaggtaaatatatttaattttcacttaaaataaatttggttacattgaaaggaaatttggctaatgtaagttagatacatttctaattaaaacaataatttaagataaataatgctcaaagaacagtggtcactgcatttattccagagagaggacatttatcctgatctgactgtaataacgtagtaggtagaactgctggcgtcgacacccaagcaaggaagggaagctggtgtctcaaggggtcccgctgagatggaaagggttcagggcccagactgttgatgtcgcctggacccaaccaccatgtctcagaagaagaaatgacactcccctcctggtgccaccccaaacaaggagcttagcagtgttgcacacaggacagtccttgcaggagacacgtttgacaagttgctgaggtgcctgatggggccaggctttttttcatgaaatgagtttgcatcgtgaggaagcctttttattggaaacctggcaggggtccaatttcccctttgccttaaccccgtaggagcacagtagacagggaggaggtcacccaggtggctgttcctgcttggcccccacttcccagaccattccaggcagggagagccgctgagatcactccatgggctgctcacatgtggtctggacgcagccgccctcctgtgcctggcaggcagcctctgggccatcagaggacccactgtgtggtgatcagtggcccaccacctgcccttgtggtgggtgcagttcacaggtgctgccccggtcctggcacactggccttcccagcctggcccaggataggggatgtgaatgatccttgcctgtgccccttcagaccatgtgaggttggacactcactgcagaagtccctccaggtcccttttcaactgagttgtgggggacttgcttagtcctcatgcccagggtcaggggaggggtgcagagtctgcaccctaaatcccctggggcctgagggaggtctcccaggtgacctctgtcctctccagtgacatgagtcctcccagatggcctcagccctctcaggtgacatgcttccatggtgactctggctcttgcaggaggtgggctactacagggacatgagctgcctaactgccatcctcctcctgtatctgccagaggaagacaacttctgggcactggatcagcggatggctgaggagaggcactccctgcagggtaggtggacagctacccccagggcctcacacagccgggccatgggacggccaccctggctgggcgatcctgacttccaggcaaggcagtttccttgctttccagcttgttaggagccttcaggacatccctgctgggggtcccagaggggcccatagctgaacagggaccctttcacttcaaggcggacacctttcattcccaacagcagagggcgctgcagcctccccctggccaccctgtgtgtcccagagccacagccctctagccctgagttcatgcaggtgactctcacttccccaagagtcctcctacctcccagctggccacactcccagctgcccccctagcccacagatgggccaatgaagtcaagatggcagtgtctgcccatcccatgtcccctagccagaccccatgtccaggagatggccatgtagtccttcagcacccacccggttccctccactagccactgcctgccccagccctgcctcacagcctcaaaggcaggcctgccctcctggcacctttacccaggatgctgctgtgcagtgcctccagctagggcccatctccctagagctgagaccacatggtagggtcacctgatggaagggaggaaggcctcagggtccggggtcccctgccactgcccagctcttccagctgatggctccacatcttgggagtgggctctgatgcatgatgggtcaggggcttctcaggtttctacagcccaaatactgcccagctccggaggctcctatcccaccaggagtaggtataacacaaatccttcccaaagatcatgcggtacctgctgagtggatgacaccctcaactctttcccagaggcccagggtcccatggggcagggaaacaagggaagatggagctcctcgagggcctgacaaggggctgagtcccagccagggcctcacccaagatgaggattctccatgggtttggagttgggtttccttttcctgccctggaggaggaggcagaggtactaggatgggggctgagctccagctgagcagggttaagggaagtgtgtccaccaggcatctgtgcatgggggagttgttgggaaagcactggccactgcccagtgttctgccccagggcagctcagggggccctgagcacctagggtccaggaagtgccgtgcattgaggtttgttgagttggctcctctggtgttttgctgatggggtaaggaggcaaatggagaccccaggccagggactctcctgtcccacaagtgcccagctcccccaggaggacctggctcaccccaagccagcaggaagcacaggaaagtttctgcatggcacagaagccaggccctcctcaagagggggcatcacactgcaggtgtcaggactcaggcccactgctatttccacattattaattttataaggtgatatggtttggctgcgttgccacccaaatctcatcttgaactgtaatttccataatcctcatgtgtcctgggagggacccagtgagaggtaactgaatcatggcggcagtttccccatgctgttctcatgatagtaagtgagttctcatgtgatctgatggttttataagcagctggcatttcccttgcttgaggtgatgaatgccccatttaccctgatgtgattattacacattgcatgcctgtgtcaaactatctcatgtaccccataaatatatacacctaccatgtactcatataaattaaaaataaaaataaattttttaaaaaagtgtgagttttaaaggtgaggtttgccctccagcgctggtgcctgccaggtgtgaccttcacatcatctttccacatggtccaggtccccatctgcagaggccaacagttcccagagtgaccttcctcagaaaacagggtcttggaggagacagtcagaggagggggcctcgtcctccccactgcacagccccttgtggggattggaagtgagggtctctgcccacaagttggcagtcaccctaagctgttttgtgggaggaagcatagggaatataggtcagtgctggaacagcatttcctgatcctgacttggagaaggtgttaaaatcttgacattcccgactcctcctttgtgagagcccctgtcctgcaggtctcacagggttgttgtgagggccacctgtggtgatgggtttggaagtgctttgtgaatgacacagtgggccttcctattcctgtcattggcctttcgaccttcaatactaattgcctggggatctccaggcctcaaggtctaatcctggaagggtatgagatgtccctagtggaatattctacacctcctgggaggtctctcacttcaaccttcacctgacataacccctgctcctgttccctcaacctggagagcttgcccaggagcacagggtagtactggactgacctctttggaaagggtgattacatcctcatttcagctctccctcctcctagttttccacgtagaaatccagggctccatgcagcatttgctggacatgaggggaaaacttttagggcaggcatctgccctgggtggggacagaggagtatcctggagtctgagtgtcaggagtgtgagacctgcccagctggccagcccctgtccccatgctgctcgatgcatgatgtttcctgcacaagcttcctttagagggaagcttccggagtgactgcagtgaggtccatgctgttgggggtgacagagcagccctggaggccctctgctcttaccctggcaggaggtggccaaaaagaagcaggcagaggaagcttctccaacacgcttggaaagaaatttccacatatcactcacgtcactcttgccactagaaggaaaatttctacagtggagtggaagaaaatgactatgctgtgggagagaatggatgcatccagaagagcaaggggggagggaaatgtgcccattgccagaattttgtgtcttttgaagacatttgccagaattctacttttgaaggctgccccttttgacagtcagttactgaggaagctgtgggacattttcaaagccttttatataaaaaaaaccacacaatatactgctgtgggtctgtgttcagggactatgaagagcacagctgccactgttctgtgtcgcagatgctgtgggaagtgccttaacacacagaggtttgcttcatgcaaccgggtgaggaacatctctaaaacattttacagtcaagaaaattcagtgttcaggaggttgaatgcgttatccaagatcacacatatgtcctgacagatttggggttcaatgaagaattatgtattttaattaagaattatgtattttaattaataattatatattttaatttcacattttaaatttctgcagttttcttccatcacttttcaccatgctttctacacttggaattactttttttggcttcttgatcttctttacttgtatgttattgattttctacaagttttaacatatatgattaaagagtatttcttaatgttttaataattatcctagaataaaatatatttactttgatgtatgcattggatattacagtgtattgtgtacattttcaaacactttgtgttataccagaagcattattcaacagtggtcatttttttacctgaactatgttcagaaaatctttccaccacagtacaaaaagatcgacttcattttgttaacagatggatgtgccatagtgcaattaactgtttaattatcctgttatcctgttgtggatatttaagttcaaacaatgcagtaataaatatgcaagagtgcttttagacattaaacaatatggctctaaattagggacctagtgcctgtaatcccagcactttgggaggtcgaggtgggtggatcacctgaggtcagaagttttgagaccagcctggccaacatggcaaaaccccgtttctacaaaaaatacaaaaattagctgggtatggtgatgcgcacttgtagccccagctactcgggaggctgaggtaggacaattgcctgaacccacgaggcagaggttgcagtgagctgagatcctgtcactgtactccagtctgcgggacagagtgagactctgtcccaataataaataaataaataaataatctagaagtacaattgcttagccaaatttcttatgcattttgaatgataagagttgctgcctcatttctgttacaaaggctatggtaatttacgctcaaaacacagaataggttggttgttgtcacatatggagtcttactgttgccgagactggagtgcagtggtgtaatcctagctcgttgtagcctccaacgcctaggctcaagcaatcctcttacctcagcctccctcccaattaactaggattacaggtgcatgccaccacacccggctaattttattcttagttatgggatcttgctatgttgcccaggctggtcttgaaatcctggcctcaaggtgacctcagcctccagtgtagctgacattacaggcgtgagacactgtacctggctgaatgagtgcctctatcctgacacttgtgtccccacgggatcctgcagaattcaggaccctgtccacacaggggaaaactctctgttggggtcctgatgactgaggagggagcttacccatggctctcctggtcatttttatttaatagtgagcacagaacctcacattttctggaatgttcccatatgattttgtgagagaaaagagaatagagaccccaaccccaagctcactgtgtcaaagggaaaattaagcttgggaactgagttacgcaatactgccttccttgttctcaaacacatagctataacttcacaaccctgtgtcatagcctcatccataagccaggttcacacagtgacagaaggccgcatgtctcctcagatgtcctccctcacaatttgctgtgaacccctaaatctttcagaatgcacatcccaccttaaactatccctaaaagtgggtcggctcaatttcaccctgacaatctcaattaccagcttattttcatagttctgggacaaggtcaggaccagaaatcatccctctgcctatcctgagatgaatgaatcattgagttttcctctactccactccctctattcacatgcttactttatcttatgtaaaatggagatttactgaatgtgagatgaacgcataactgtttcctctgctccctcctttcctatgtaaaatgtagatatcctgatgctaatcagagccacacaagaatgcaagcatttgcttcactgcctaccttcagtctcgcgggagttctctggatttcttgtatcagcatgtggacctctttagcaagattgaggacagtttcctcaattatatcctcaaaaacgttttccaagttgctcactttctcttcttctctgttagaaatgccagtaagtcagctgggcacagtggctcatgccagtaatcccagcactttgggaggccaaggtgggaggatcacccgaggccagaagtttgagatctaactggccagcatggcgaaaccccatctttactaaaaatacaaaaattagcgaggcatgctggcacacgcctgtaatctcagatacttgggaggctgaggcacgagaattgcttgaacccaggaggtggaggtttcagtgagccaagatcatgccactgcactacagactgggtaacagagtaagattctgtctcaaaaaaaaaaaattccaataagtcatagattttgttcctttacataatcctacatttctcaaaagtttggttcattatttttaaattctttttttatttttgtctgactgggttgattcaaaggtctggtctttgagctcttaaattatttcttctatttggtctagtctgttgctaaggctgtgaactgttttttgaaattcctatagtaaatttttcaatgcaagaagctctgcttggttctttctcaatatggctatgttgtcattcaaatccaggatcgttgttatggggttgttgctggatttcaactttctgttggcttttggtgattttttttgccacttatatcttgagtactatacctgtcatttcagacgttgcattctggttaggacgcattgctagattgctggtgtaatcctttggaggtgatggaacattctggctttttgtattgccagagttcttgtgatggtttcttctcatctgagagacttgatgcttcctttgttgaatttgctatcatttggaaggagtttttttttaaatttttcattctttctttctcttaagggtatgactgtggtgtatgttgtataggatcattttgcttcatttctgggtactttcagaggaccaaggctctgtacaagttccttggttgcagataggctcctgtggtggcttggtgtggtgatgtatttttgtttggtggtgtaattcaggcttcagtccagtagacagtgcttaagagtaacagctggctgcagggtcttctcctctgtgtacttgtcctcgacaggtgcagaagtgacaaagtgccaaaagcgccctgtcccagtgggtactagtcttcagcaggggcagagctgctggagaaacctaagaagcagcctctttcagcccacgttccttgggtcccaacaggatgaccactgctggatctgcagcagtgcactaggaaagggacagagggcaagagatgaccacctctctaaatctgttcctaggctttggtgtgcccctttcagcagctgatatcgtgatcgtgtttcctttgacccaaggggtggctttggcaagctgtattcctccttcccttagggctggtcctcaccaaagtttaggtctcctggggaatggggttcacctccctcttgtttcttggaactgatggagtactctctcaactgaccaagggagcaggctgagacacccagcaatgacacacacagaccagttccaggttgcaaagctgttcttggctgcaagtctcaccatccttgagaaacctctgctttagcaactctcttcccactacagtcctgcaagaggaaagagcctaattccaacacttactgctggagcactttccacactcaacactcaattctggctgttgaggctgctcccctgctccagagcaagcactccaattcctagcccaagattaaagtgtctgcagtggccaccattgccaggcaccaaaaaatgattgactttgtatgagcccagattaaaaagggcatccttctctcagtcccaggtctgggtaaatgcctgcagcttttctgagtgtctttcctctttccccatctctcagccacttttttgctagctccaaggcttgggagaaacagagtgttctcccttaatctggattgcacaaatccccagtgaaaaggtgagttgcagagggagactggctgctcttctctcgtactggagtttcactcccttctatgaaccaaatgctatcacagagtctgctttcccacctccccgtccacagggtctggagtgttcttctctattcctgtgaattcctatttttcttcttgaattgaagctcacaaagtttatctttatgcttatttttctacttccaagtggctgaggcacattgaaagcccctaatccatcgttctaggaaaaaaggatggtttaaataaaggaatgttcatataaaatatatattaattagtgcaaacatattttatttgacatgagttaggtgaatctttgatacattaattaattttaaaattgttaaataaaattagaaatatcttcgaatttgccaaggtatgtttctctcctgggattactggtcagttttattttttccttggatagacattttaagccataaatcttgacatagacctgatgtagacctccatacctttcccagatgtgggacggagcaactgggacaggtccatcctagcactaagggatgattaaacctaacttgtagtcattgtacaactataaacatggttgatgctttaagagaaagatcttgatggaaagggttaaatgtaaaaattgatcatatgaattgggtcattcttatcacaccaaataaaaccatcaacgagccagggggaggaggcattcagggcaaaaacaccactccaaaagcgtaattctctgcatgcctggctgctgaaattacctgctttaagctgaaaccagttttatcaaatggttactgaaacaacctcttgaacactaagactagctttacccaccactgtccctcacctatcagagcctgccagctctcaaaaaccttactggtgccagtgaactttctcaaagagaaatacatactgtttttctctctgtctcccttttttataaaacctctaactttctctttatgttttggacatactaaagacacccattctgcatgtatgtgtgaaattgtaatacttgtatctcaaataaaacattttaatttcagatgtttgtctctatatttatttgactttgacaatctgatattatttagcattatttccagtctcccaaataatgtcaaaattttgttatgttagataggaatatcttgttattcaacttgaaggtaaactgcttgatcaatgcatgtaattccttgacagtttgtcagcacctctaagacaacatgtagatattgctcattattaactcatttcatcttttcatgataaattacaaaaatttaattttcatttttaaaatgcaaaccattatgccttgtattatggcattcttgcattactataaaggaatacctaagcactacataatttatactgaaaaaaaagattgacttggctcacagttctgcaggctgtacaggaagctttgcattggcagttgcttggcttcaagaagggtcctcagggagcttttacacatggcagaaggtgaagcaaaagaaggtatgtcacatggccagagcaggagcaagcagggagaggtgccacacacttttaaacagccagatgtaatgagaactcactcactcttgcaaggacagtgccaagaggatggtgttaaacatgagaaatcagccctcatgaccccatcacctcccaccagaccccgactccaacactgggaattacaattcgacatgagacttaaagggtacaacatccaaactatttcattccatccctggcccttcaaatctcatgttcttctcacattgcaaaatacaatcatcccttctcaatagtcccccaaaagtctcaacctgtttcggcatcactcgaaagtgcagtttcttctgagacaaggcaagtcccttccactgatgcgcctgtaaaatcaaaacaagttatttatttctaagaaaattggggtacaggcattgggtaaacattcccattacaaaagagagaaattggccaaaagaaaggggctacaggccccacacaagttcaaatcccagcagggcagtcattaaaactcgatgttccaaaataatctgctttgaaaccatgtcccacatcctgggaacatagagcattcccatgatgcatagggtgggctcccaaggcctggggctgctctgctcccacggctcttctacactgaaggcatgagctgctggtggctctatcattctgggatctggagggcagcagcccccttcccacagctccactaggcagcccccccagtcaggaccccgagtggggcctccaaccccacatttccacttggcactgtgctagaagaggtcctctttgagagctccagtggtgcatagtcttctccctgggcatccagcctttctcatacatcctctgaaatttaggcagagaatgccaagcctccttcactcttgcactttgctcacctgcaggcttaacaccacatggaagccaccaaggcttatagtttgcaccctctgaagccatgacctgagctctatctgcagccctttgaaccaaggctggagctagaagggccaggatgcaaggaacaccctcctgggggtggtacaggacagtgatgccctggccctggtccaagtggaacaggaattaaaagaaattaaagaatgtgtaagcagaaactcagttgtatgtgagaaaacccagttccccctgagaaagagaaagagctggagccctttaaaaattaactgcctgtttttctgtggctagtgagcttcatctctcctcctttcccaggcattgtgaagaccctgtttccctagctgtgcagctgcaaggtcactagacagataaactcaagtcgtaaaacatgtttttccttgaaaagtaagaaatgatataatgcatgtctcaattaattgaataactgtctttgtttctcacttctgtaatatgcttccccctgcacagatctccccactctccaccaccccacaaaatgcttaaaagttaacttaagtctttgttcaggactcagtcctttggttgttaatctgactgggccggtgcacctaaataataaatatcctcctcaaccccatcagtctctctgattccttaaaaaatcccgctacagcctgggcacggtggctcacgcctgtaatcccagcactttgggaggctgaggagggcagatcacgaggtcaggagattgagactatcatggctaagacagtgaaaacccgtctctactaaaaatacaaaaaattagccaggcatggtggcagtcacctgtagtcccaactacttgggaggctgagacaggagaatggcatgtcccggaatgtagagcttgcagtgagctgagattgtgccactgcactccagcctgggagacagagtgaggctccgtctcaaaataaataaataaataaattaattaattaattaatttttaaaatcccactacacaagaaaccattctttcatcctagacctctaggtctgtgctgggatgagctgctgcaaagatttctgaaatgccttcaaggcctttttttaattgtcttggctatcagcacctagctctttttcagttatgcaaatgtctctaataagtggttgctccacagcctgtttagattcttcccctgaaaatgctttatcttcctttgccaaatgggcaggctgcaaattttctatacttgtatggtctgcttcccatttaattgtaaattccaactttaagtcatttttttgctcctgcatctgagtgttcaaacttcctcagatccctagtacatgaacagactgcagccaagttctttgcaaaggcataacaggcatgacctttattccaagtcccagtaagttcctcattttcatctgagaccgcatcagcctatccttcaccgtccatatcactatcagcattttggtcacaaccatttaactagtctctaagaaattcagaactttccttcatcttcctgtattaggagccctccaaactcttccaactcctgcccattacctagttccaaaatcacttccacattttcaagtatctttatagcaatgccccatgtctcagtaccaattttctgtattaggccattcttacattgctataaagaaatacctgagactgggtaatttataaagaaaagaggtttgaaaagaggtttgtatagctgcaggctgtacaaacatgattctggcatctgcctagctcctggtgaggcctcagcaggctttattcacggcagaagatgaagaaggagcaggcaggcacatcacctggcaaggcaggggaagcaccacacacttttaaacaaatagatcttgcaagaattcactcactatcacaaagacagcaccagggacaggatgctagaccatttctgagaaatccacccccatgatccaatcacctccctccagacctaccaccaacattggggatatcacaattcaacatgagatttagagggaacaacatctgaggtatctcatgcctcatgttgtgacttggtataatgtccataagattacactgactttacacatcatattgcagtttttgctagctcttctgtagtaagaaaatggaattcatcagcaatgccttctaagtctggctctgttttcccatgcagactattccctgagctctgcttgtcagtcttgctagaacctcaccctaggcagcaacctccagtctgagattgcccttgacagtggctgaggtttgcattgttggaatggattagaaaaaacaaagggaagacagaccaaaacagatttaaatacagatcccatttgttgaagttttaagtaattgtaaatgtttatttgcaccagctgcccactcccattgtactctcctcacccaaaaaggtgacttgatattctagtaaaaagccaaactgtgctttagagaaacccacttgttacttctttaaatccatattatttttccaaagtgaatttttcttaatatgctctggcagaatcagtaaactaattatttacaccagagtcacttaacctttcctcttggtcatttgcatgtaaattatttttatatgtataaaatttgcttactcaagaaagctcttgctatatatatatatatatatatttttttttttgtggtatcttaacatactctagtcttgtcttgaattccttaagactttgaggtaaagaactctattgtaacaagtttccaaatcaaagtgggaaagaggaagattaggttaagcattaggtcatcaggtatgtaggacagctaattccattatcagaatggtagtgatagccagtttgcattttgtatattagttgtaacgaaaatattcagcatattagtgacaaaaccaaagttattgtgaatcagtttataatttattttttgagataggatcttactctgtcacccaagctcaagtgcagaggcatgatcttggctcactgaagcctcaaccacctgggctcaagagatcctcccagcccagcctccttagtataggtgagtgccaccacacccagctattttttctctagtttttgtagagattgggtctcactttgttgccaaggctgttctcaaactcctgggctcaagcaatccttctgcctcaacctcccaagtggtgctgggattacaggtttgagccaccgcacctggccagtttataatgttaatggcttttggagcaggaaccagtgggtgctgcttcttgtctgcaagatgaggagtctcctctccccagaagtgaggcatcttctaccacaagggaggctttgcccaaacagtcaccgaaaggcagagattggggagagaacaaaacaggagtgaatatgttcctggaacctaactgctccccaattcaattctactgcagacattcagaatgaaggggacattcagctgaagaacaggagtgcactggctgttaaaatctcagattgtaaaaacaattttgcttcattttccttaaataatttttaaacaattgttcttaggtgattttctaaacttcaggtaatatctgtgacttagtaaatgttctttaaaagatgggataatatttttattttgtttaattatatgtgtttttaaactaattttataggaaaaataatttctttccttccctgttataccaaatacagcctttagctcaagacacaagtaattccaggaaaactggaatgtaagttcaatatgttgcactaagtacatttgaaagtgcatgcatttttattttaattcatcattctcagtcaactatcgctggaaaccatcattcttagcaaactatcacaaggacaaaaaaccaaacaccgcatgttctcacttataggtgggaattgaacaatgagaacacatgaacacaggaaggggaacatcacactctgggggctgttgtggggtggggagagcggggagggatagcatttagcctaaggctaaatgtcgagttaatgggtgcagcacaccagcatggcacatgtatacatatgtaatgtatacatatgttaatgcaccaattctgcatcaagtcagtgcaatcagagacactgcaagaatgacttttggttttcttttcctagtttttgaaagtttctcaagtctgtcatactggactctgtattacatcttgaatttttttcacttactatagatctcctatacgctcaattgtttagctattaccttaacatttaccctgtgaacccatgacatttgaggctgccaaagtgattattacatgataaaacatatactcggttaaaggcaatatttaacaattgtaaaaccaataaatcaataattaaatctttctggcttagacttaaaactgcttaatttagtcatatctctacccacaatatagggattccagcaagggttgaaagtagagttggcaagcatttccattctcttctgggacaataattcttactaccaacactggttctgaccagtgaaattcaaaatcagtgaaacactactcagagtctgagtgagccaaaaatagtttcactttaggaaaaagtctatatccttagatgtgagtgattctctgtgaacattttattcactttaatatatttaaagaaaatctttctgaattggtgtgttttctttagtttgtattctgatactttgatgctaaaagcttttgactttaagttttcatggaggggctatctacataataatttttatacatcattatatgcatcaatgattaaaaaggagtagaaatttttacactaattgagaaatattatagacctaactaaatgcgggcaaactataagcaatttggggaaactataaggatgtaattaaatagtcactgtttttagaaaccattaactgcatattgaaatcttgacacttgttgggaaaatgaggtggtaaatcaacttgtcagcgtgagtactaaataaaacaaaatatggttaagagtgtccctttaaagttcagatagtagttctgcaatttctgattttaaatgtttctgcaaaatagtttatctgaatgattaaactattattccgtgttcaccaaccattaagaaaatctgctgtatgaccaggttaaacctgaaaatggtataattcaaaacttgatgtaggcaataggtatgtagaatgtgtttattctaatatgagagggcatatcaaagtaattttcttggagcacactgtcaaaacaaagcaatgggatttggccatggacatttcattattatcaaagagacctggacactaccttagagtaataactttattatttagcaaagatgttttataaaaagaacaacaaaatgagaggaatagaaatcacacaggtaaaacagataatctgactttgtgggtctcagagcagagattagtgtctttcagtttcagagtaaatgacctcactgcatttctctgaactgtcatggttgtcacaaatatactgtgttctaactcactccatgatttaaggtctacaaagtaacaaaggcaaaataacctatatgctctaccatattttcctcaattctagtgttcttcaaagagagaatgttttctctaaatctaattgagagtaattctgtatggatcgctaaacctttcttcaggcagttggagtaatatgtgtctagggctaactcagaggggtcttttatgtcttttaaaagaagctaactatactcttgtgatatgataatcaccgtcattgacttacagtttctaaggtttgaagggatattgaacactcaaggggctcacattcttactgattcatgaatctcttcaggtccagggaacttagtatttttcaagagtgcaaaatgcctagagacagctgggaacaaatgaatgtcattcctgatactgtgctcatagttacttgagcttcatctcagaaaacaaattgtctggtgcaatatttcttacaacttagttcctaaatgaactcaacaaactagttcttttgttttattttatttattactattatactttaagttttagggtacatgtgcacaacgtgcaggtttgttacatatgtatacatgtgccatgttggtgtgctgcacccattaactcgtcatttaccattaggtatatctcctaatgttatccctccccactccccccaccccacaaccgtccctggtgtgtgatgttccccttcctgtgtccatgtgttattgttcaattcccacctataagtgagaacatgcagtgtttggttttttgtccttgtgatagtttgctaagaatgatggtttccagcttcatccatgtccctacaaaggacatgaactcatcattttttatggctgcatagtattccatggtgtatatgtgccacattttcttaatccactctatcattgttggacatttgggttggttccaagtctttgctattgtgaatagtgccacaataaacatacgtgtgtatgtgtctttatagcagcatgatttataatcctttgggtatatacccagtaatgggatggctgggtcaaatggtatttctagttctagatccctgaggaattgccacactgacttccacaatggttgagctagtttacagtcccaccaacagtgtaaaagtgttcctatttctccacatcctctccagcacctgttgtttcctgactttttaacgatcatcattctaactggtgtgagatggtatctcattgtggttttgatttgcatttctctgatggccagtggtgatgagcattttttcatgggttttttggctgcataaatgtcttcttttgagaagtgtctgttcatatccttcacccactttttgatggggttgtttgtttttttcttgtcactttgtttgagttctttgtagattctggatattagccctttgtcagatgagtaggttgtgaaaattttctcccattctataggttgcctgttcattctgatggtagtttcttttgctgttcagaagctctttagtttaattagatcccatttctcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcagctttgtcaaagatcagatggttgtagatatgtggcattttttctgagggctctcttctgttccattgatctatatgtctgttttggtaccagtaccatgctgttttggttactgtagccttgtagtatagtttgaagtcaggtagcgtgatgcctccggctttgttcttttggcttaggatcgacttggtgatgcgggctcttttttggttccatatgaactttaaagtggttttttccatttctgtgaggaaagtcattggtatcttgatggggatggcattgaatctataaattaccttgggcagtatggccattttcacgatattgattcttcctacccatgagcatggaatgttcttccatttgtttgtatactcttttatttcattgagcaatggtttgtagttctccttgaagaggtccttcacctcccttgtatgttggattcctatgtattttattctctttgaagcaattttgaatgggagttccctcatgatttggctctctgtttgtctgttattggtgtataagaatgcttgtgatttttgtacgttgattttgtatcctgagactttgctgaagttgcttatcagcttaaggagattttgggctgagacaatggggttttctagatgtacaattatgtcacctgcaaacagggacaatttgacttcctcttttcctgattgaataccctttattcccttctcctgcctgattgccctggccagaacttccaacactatgttgaatatgagtggtgagagagggcatcccagtcttgtgccagttttcacagggaatgcttccagtttttgtccattcagtatgatatttgctgtgggtttgtcatagatacctcttattattatgagatatgtcccatcaatacctaatttattgagagtttttagcatgaagtgttgttgaattttgtcaaaggccttttctgcatctattgagataatcatgtggtttttgtctttggatctgtttatgtgctggattatgtttattgattttatgcaagaataatctaaatttctctggtgaaagaacctaaacatgccttttaaaaatttatatatcattccttttgtaaaatctaatgaaaataacaattttgtctattgtaaaaggcaagtgattgcaacagatggaaatcactttatttcctatatctttgtaaagataatgactgctaataaacaacatgaagaattttcaggtataattttgataaaaatttaatggttttgggcttctaggccaaatctgcaatacaacccttcataagattgtactttgaaactctcgttgtcatctgacatatgcagatagtacagaaatataatcccctttctaaatgtttacattgtctccctggtatgaattagcttgctggaaacatcagtaatcactgacataaagatcccactattaaataaaactgatactttttaaaaccatgcagcaaataagaaacatttcataaagcaacacaggattttatatgtttcccattccattagaggctattatgctgaattggatcctcattccaacctgtgtccatattttagggttgaaatagtctaaaacataacatttactgttctcctgttgtgatatctgtatagctaatatgttcacattctctgtattcatctatgttaataattttaaaaaggaaaagaaagggggctttaggaagaactttacatcacacgtcagagtaaacatcaaatcaagttctcaattcactaataaacccatttaagaaaaagtattccgctagagagcaatgaatcttattgtctttgtgtctgatccatatttctccacctgacacatggaaataaccagagagttactataaaatacctcaggtgcattgttgaaagtaatttcctgcttttgtgggataactgaaacataaacgtaaataagatagtttgaaagttcactttctcatcaatgctcaaataatttgttctaataaagcccagtaaaatttagcttgtaatgccatcaaggtaaatatattcatgaagtactcacttgctaaatttttaaacacaacacattatctcatctttaagctttagctgttatttcaattatccattgctgtgtaattagcagtcatcaaacttagttgcttaaaacacaaactcacaatttgttaactttggttgggctcaggaggataatagtcggagtcttgcctaggtttccttatatgactgacaaggcctacatagtccaaagtgacatcactcaaatatctggcacttcactggtgctatcagctgggttctcctccacttagtctctctggtagagtagatcaggttctcatttggcattgctgccattttaatttggcaagcctaaatttactataatttgtcaagtgtctattaagtcagtgtcagagagggctatataaggatatggctatgaggagacttaataaatcgagggttctttgatataacaggctacccagttacatttcttgttctaaagattttttcagatacaacaaacaatattttacaatttaactggtagatgaatgagtttcctgagatataatttaactaagcaaactctttcatactaaaaatcttatgacctctttacccatcttaggttttaagattgatatgagaggtattctggaatagaaatctaaatttaaggctagagtcaagagtgccgaagataagactcttatccaaaggaaaatcaagcaactgctatgtcttgcaaaggccagtgagcagacagaggggagagaatacaattgcaccaaataaagactcactttggaactcagtgattatatgtgtgcatatatgtgtatatatatgtatattatacatgtgtatgcatgtatatatgtatattatacatgtgtatgcatgtatatatgtatattatacatgtgtatgcatgtatatatgtatattatacacatatatgcatgtatatatatgaatatatataaaactgaaaactgcacacatcccatatacaccatatacatgaaagtgaacacacacacatacataaacatatatattcagtttcaaacaattgttagggaacctgaggaagaaactaaatggaatataatggttgcatctatgatagccatggtactagaactagtagtagttctactaaggtgagaattgacatagtaaaagaaataagatacaaagcagtaagagagagctacattttccttaaggccaggctgaatattcactaacaaggaaatttctacagtcattattttaatctgattcattctcttggtgggatattccagagttaccacctacagaaattccacttttccttaccgaggttctctttttttcttctcagtccaaatattagtcattttggtagagaaggcagaaacaattaacaattgagtaattcctcaggaatcatgttaaaaggtttccaaatcatgaatgtatagttatattttgttcactagattttaacccacatacctcacttgtagagaaattatgcttatttggatattcaatatatttcttcatacaaagacaaaatctataaaatgtacacacacacagatgctatggatacatgcacacatgtgcacacacaaatatgtatacatggtttaccattattttctagatcattcagaggtcagtattaattaaaacatcatagatctatggcaaattttgggccacttttcctaagacaggaatttaaaaagccttcaattgtcataacaatgggaagaagtctgagagctggagtaagggaagttggtgctcagaaatattaactaccatttatataggatatccttatgagataatcttaaagccaaatgaggctaaaatattaatacgagttatttagccaagttttccagcaggaagaaggaaataagcagtgaactaaaaagcatacaagatacagaggagcaggttaaatgaagccattacagcagaaattgagaagaataaacaggagttagaagatgagagcaagcaattgcaagtggagtgggctgagctggaattatggtgtagaaaatgactggttgagaaaaacccaaacaaatatttctataatgtcatgtgcataagatacctgtagatgttatcaaggtatatacataaactacctgtcattagagctaatttcttagcaaattattcataaaagtttataactttgtgaggcattacagacaccaaaactaatgatttggcatttccgtggcccaatttgtctaaagaactatcttttacactttactgttttttaataggcaatacagtgctcaaaaagtcttttataccaagtccagtaggttgataacattgagtataactgagtattgctttgtgtctaccctcaggcaaatctggagattttctcaagcctctttatgaaaatggagagacctcacaagagatgctaatggacagctgaccctgctccctgctccatcacaggttgtagagtattaattcccaagttacccagacatttagttctgaatgtgcaaaaatggtttaggttcaaatgttttcaactactgacaagctcaagaattcagaggaggtagtactaagggaaatgtaattaatatataatatcaaaacttaagcatagcaccataacacctaatttttgatgatgtcaaatacttaaagttctccctttttattttctggtgaaaggtgcgtagtatacaaacctctactaacttcttgggcttctgaataaaggaaaggactacctaatgactgtaatagcttgactgctgaagaattatgtcaattaataaaaattgcttcataggaaaaagatgaattgtctcttcaaagtttttttaagcatgggtgaccaaagccatcccatacttagaagaaaatattgcattgttttatacaagatatgctgtacacgttacagaagattcatgtttaataatgcatcttgtaaaaatcttagagagctataaccttacaacataacttaacccaaatacattgaaaaccccttggatttagacctacagggaggtggtttttctttctgtaccatagcacgcatagttgaagcaaacatactccttcaaacataatactcttacataatagaaagtgttctctgttttctggatgaaaaggcatgaggtcttttgtattagcaaactgaaattgttaactataaaaagtcaaaaatcaaaggtgctctcacttatttataaggaccttgaatggctgagattcatcaggaaaaaaaaacattcctcagagagtctgatctcaagctgatgtttctttattgaatttgattctaaaccatcatttttgttgaaacctctgtgctttcagaatgctgaaatgtaaaatatttttaacttatgaaagagataatttatttttattttctcctatacatttttaagtagcaccttaaaaaatagacaaatccatccagggtcaaaagaactcaactcaattctctatcactgtgaaaatagacttagttcttcattacaaaagcactacaataactacaaaaattatacctcctggagtatatatttacatatccatgcaaaaggggaatagattaaaagatgtttatgaatgtctaaaaccttaagtcagtttaacgtagtattataaatcaggtttgtgggtgatattttgtctgcttctagacttgtgagcaagttattaagttttaggttacttatatttaaaattcaaaaaggaaatgattgtgattgcattcaaagaaagagaggacattttgaagcttcttttttttactaatatcaaaacataatatcacatttgtaaaacacgttgatggcttacaaccaagtaaaatacctcaataccccacttttcaagatcagtaatattggcctaagagtatcactctataggaattataaaaagttgtatttatgccctgagattataccctataatgtgcaaatattataggatagacaagtggatataaggtttctttctaggtttccttatatactccaaatggtaaaactagatggaagattaaaattctaaatgttgttaattttagaaccttcaatgtcagagttactttgtatgaatgagtttagctaattttccacactatgcatatctaatagaaattactattgcacaggtgagaaaactgcatctctgattattattattcactctagtcacagagataagaaagggcaaaatatcataatagaagcccaaataggtcttattttaatggaatatttttccactggacttcaactggtttatcttatttatccatccatctaagatcagttgaaaaaagagacttgcagatgcaatattttagctaatatatccaatctcctatttgaaatctcctgcgtatctaacagaaaactcaaatttagtatgtctgaaatcaagctgactgctgcacgtgttcacactgaaacaaagcaaaacaaaattccttcaacagcttttctcatctcaataaatggtactacactgtgcctgtatgactcatgcccaaaacctagaggtcgacctaggttctttttttccccatgactctccatttccaagatttccgtttcttccgtgaacacttctcaaagccacacccatctctctgtcagaataccacaatgcattgcaaatctgcctccccacttgtcatctcctccctaaatgctctattttcacagtagtcagagtggcttttttttttaaagcacacaagatcttgactcttcattccctactttctgctttaactccttgtttggctttcctctgctaatataaagaaaaatttccaacttctttttaatgaccatagatcctggcttgatgttttctacctacctctccaaccacgtcatacacttcccttcttttcttatcacacccaaaacattcttaattatttccacagtctttgtatatgccaaccctttttctgcctctagaattttgtgcttgtttctctttctttctaaaataagctttcttggctttttgtaaaattagatcattgttctttgaaatctcggctaagaagttttctgaaataccttaattaaagttccttccctggttactagcagtctcctcacttcgtttatttttattgtaatctttaatgattgctttctatttgtttgacttcttgatcaactcaaatttgtatcctcagctcttatcaaaatactaggtaactacacacttattaaaacaactaaacataaaaatagtgacaacaaaagctggcaatgatgaagaaactgtatcattcatacattatttgaattgtaaaatgttataatactctggaaataatttatcagtttctttaaaaactaaacatatatttataataagatccagcaattgcacccctggaaatttatctaagagaaatgtaaacctatatgcgatctttaatatctttcatagcacctttaattctaacagagaaaaactggaaacatccaagatgttggacaggtgaatggttgaataaactgtggtatatccatatgattaaatactacccagaaataaaaaagaatatacttttgacacatgcaataacttgcatagatctgaagggcattatgcttagtgaaaaaaagcaaatatcaaaaggacacatggcatattatttcatgtatataactttaataaaataacatacatatagaaaacagattagtgatttccagaggttagtgatggtatgggaatgtgagatgaatatggctataaaatgtgaggaagacacttttagtgatggaagagttctgtaacttaattgtaataatggtcacattaatcaatacgtgataaaattggcatagacctatgaattcacattgtataaatgtcaatgcctggtcctgatattgtactaaattatacaagatgtaactcttgaaataaactgtgtagaatagtacacgagacctctctgtatttgaaactccctatggatctaagatcttttcaaaataaaaagctaaaaaatgctaagtgttcaataaataaaatagtaactgtattttatccaattcttaccatataaaaatgcttcacatacattaactcatacaattcagtctatagcaagatcatattgatgccattattagtcctaatttatggcctagtagcttgttcaaggtcacatagctaataggaggaagggttatgattttaatccaagcaaccagctccagagaatgtgctaccaactgacacatcacagcgtttctcaaaaataattctggatggaaggaaagaagggagttaaggaaggagagagagaaggaaggaaggaaggaaggaagggagggagggagggagggaggaaggaaagaaagaaggaaagaaggaaggctggaagggagggagggagggaggaaacagggaaagaaggagggaaggaaggaagatacaataaaggaaggaaggaaggaaggaagaaagatacaatagccagtatatttactcaaagagaagacatcataaaacccttttaacaaacacagcctgacgtctcaaattccttctccattcaacttccttgactgtagagtcctattcagggtcaagggaaggagaaatcaaactaaagatcataacgctgcatgtatgtggcattgtattgccagagttctctgagtaaacctttctagagatgcacattttgcactctattggaaaagttatcttagttataatgtttctgaagatgcatttgccatattgaaagcaagcagtcacatacaatttgatagacaccagcacaaatgacaataaaaacttggtaaagttgaagagactgcctttgttatatctaatattctatcaccccagatctatcttctcaaatctccacattacttagcctaaccctatttttctattttctagaggagcccaccacattgatcaggttgatttattcacattttcccaaaaatgctaggtagattccttcctaaatccattagtaagttatagtctgtattccccatggatgaactgtgttcaccagttatgactcttaggaggaacttcatagaagatcttcagtggcatctattggtacatgttggacattaactaaaaatgtatagttttagcaaccaacagattctattcttatacctgttggtcatgtccaggcagttatgtgtaaaataattacacaatgtttcaaaatttcaagatgtttgcctacctatatagtgtccttcactctcctctccagctttccaaataatatccataattcaaagaccagttaaatcctacaggcatattcacagaataactgccctgaaaacattgcttaaattaatgagaccatctatgggcaatgcatcttcaagagctcaagatctggtgaaaaaatggaaacaaagatgaaatttcaatacaatgtgatgaaaattttaaattatttctctcttgcaaatttccattgcttgtttgaacattcaggagaatagtactgctttcccattgaatgtataaataaatgtaagaatgaaggttggccctccctccaaattcattaaacattaaattttttaagtaaaagataagagggctgtatgaaaattaaaattcataattacttccaatatagaaaataattgaaatagataaaaacacaaccaaatagaaatggatattgctaaaaatcaccttcttaattaaattagtaacaaaagtgaaattattgttctatccatattggtgacattgcttcttaaattattcaaattaaaatatattctactggtgagttcaggaaaaattgacaataaacaaatagtatcatacacaaagaaatataactcactgttttagcctagcaactagtgtttacagaacaagttacagattattctgcaataagaaacaatcctaaagtgtttttaaccttaaatcaaaattcaaattagaattagaaatgaaatgatgttctcatttcagcaatgaatacagaagtgaaatcacttgatttttctgaagactgtatttttcagtgttcatctggatttaacactttaaagaataccttttattccttaaataacattcagtttgtgaaagtaagcacacctttttcagctccgcttattctgcagaaggatccttccatatcaaggattaacacaatatgcatcgtgggttcacaaagttcagtttgcagctatccttagcaaatcatgagaaccatctggactgattgatgtggagattgaaagtaattgatcctgccattgagaaactttttgaaacatgaaattaaacaagatgatattaagcattctgaagtccatcagagtggcacatcaaatgtgttactagctgttcattttcctttgtatttttataaagacccttggctagcagaatggaacagaaatagaagctaaaagatctagatattgatgtagtgatcaaaggcatacagctggtttactttgttataataatattttatgtggtacatgaagactttgatcccttgacaaatgtcctttgtaggtgagcaattattaataggattgtaagtcttaatatgcaaggatcaccattaataaaagtagactattgtaaagtgaattagcaataattttacttatgaataaaaacttatactatttcaggtcattttcttattgtttcttgaaaaaagaagtcctttataagtccagttaaatattacctaatttttgcataaaatttcatggtaaacaaggcttattttcttactttactgatgtctaaaagctaaatttcactggtgatatatcatttgtttaagactaggtaactgataacctaagctgagacccaaaatttgttattttctttatttccagcacaatattttccatcatggtaaaagaagctatgtttctttagcaagacaattgaaaagcataaacaatggtttactagaaagatttttaatattccatattatttacaactgtttgcttatttccatgtataaaatgacattgattcaatagactttttccacatttgcatgatattcagctataacattaactcaggcaatattcatatggctccagaattaaaccggtatctgacctcccaattgaattagacgataggcattttgtgatttgaggaagacatcctatgaatttacaaatgtccagaaagttatacaaaagaaaaacaaaagactttagtctagttaaaagtagtgctactatttcttgaaattctgaaagctgtaataagtatcactcccaaatctggggataaagtacagaaaatggcagctcccaatataatcttggacatatttgtcattaagaagcacaatgaaatatgacaaattgtacagcaacttttaaaaattgctaataactctttgtttatctcagtagtaaaatttaaatactgatccaacctgacacatatgaacataacatacctattctgaaagacaaagaatatgtatcaatatttatattatatttaatacaaatcatggaatatagaattatagaattgtgcctacttacctagaaaatattaccccaattttgtttttctaagcttcaagagagatttcttggagaaaatgagattttataagcaatgctagcaaaaaaagacaacttaaaagattatggagaaaaaggcgtattttagatacaaaacacagattgagaaacacttaggggcaagaagtaatgcatcactggccaatgtaaatgaaccgtttaggcagtaaaatgtgtccaagcaagtggtgagtatatcctgttctcttttatatatctagacaagtgatttcaaacacccacgtggagccctgagaccctgggtgttcacctaatgtaagccccaatataggagctgaggtcaactaattgagggaatatgtccaacaatcaataagcaaattagaatgagctaactgtcacacattcttaccctcatccctttgctgcattaactgagcaaacagctctctctaactatgtaggaaaagtgttagtactcaaataaaaaggtaaatttaataatctgcttaaggctgtatgaaaaaatgaagcaatgtgtatcaggtttcttcaaatatatgcatattgcaatccacccttatttaccctcgattgtaagagctaaaagcaggccgggcacggtggctcatgcctataatcccagcactttgggaggctgaggtgggcggatcacgaggtcaggagatcaagaccatcctggctaacatggtgaaccccgtctctattaaaaatacaaaaaaattagttgggtgtggcggcgggcgcctgtagtcccagctactcaggaggctgaggcaggagagtggcgtgaacccgggaggcagaggttgcagtgagccgagatcacaccactgtactccagcctgggcgacagaacgagactctgtctcaagaaaaaaaaaaaaaaaaaaaaaaggaaacattttgcaaatgttgaatttaaatgcatatttctgctttcatatagcttatatgataataaagctatatgcaccagcagatatattaagttttatattatataacatattatatatattttacactagataatggaaaaatggtacctattatgttggtgaccacaattttggcagccttagaaaaacttcagggccgggcacggtggctcacacctgtaatcccagtactttgggaggccgaggcgagcgggtcacgaggtcaggagatcgagaccatcctggcaaacacggtgaaaccccctctctactaaaaatacagaaaattagccaggtgtagtggcgggcgcctgtagtcccagctactcgggaggccgaggcaggagaatggcgtgaatctgggaggcagagcttgcagtgagccgagattgcgccactgcaatccagcctgggcgacagagcgagactctgtctcaaaaaaacaaaaaacaaaaaacaaaacaaaaaaaaacttcagagcataagccaaaacaattagaaatagcatggctttaaattaatttttcaagaatcttaaggtgacaaatattctgtcatctgtcatgcaaatctagttccacagaagggcaaattaggaatccattacctggaaaaaccattcctcatgcctagaagaagaatctctacaagtaggattcttgctttcaacatgcccttataaattggagtcagactgaatcattttttcttggcaatggacaagaaaatcagactgtaactgtagctttgtcactgagaattggtcaaccatttcaaaataggttaagttttctccctctgatgtttctactggggcttgaaggattgataaatatgcttctattctctgtcagaattttgaactaagggagagataccaaagattcaggcagatggagatcaagatggcaggtttatttttaaaggagctatggggaatctttgtggtgacaatagatttttctgttactgtagacacacataccttcccagccacaagtggtgctagacaactgcacacctctccatcccacctcccatcccaacagatacataggcattttcttcagatgttgatgaaaataattattttatcactatatccagataattccaacaagcaatatgcttgttgaggtgaaataatttttctaagatacaaacagaaaatatatacgattgaaatagacactaggtgatatttcacatatgcaatatgagctctgtttctttgacaagacagatgaatgaagaattcatgtttgaatgattggcattagtctaaagtattaaataatgaaagtgtccatattctctgcccagtatgatcttttaaaatatcatccacacaaatacaagtgaggtcatattttttacaatgaggcatcaaatttaaaggcagcaaaaaagtaatgaatatacctcttaggctaattgtttaccttagtggctttaatgatatggaaagttgaagtttagagtgagaaaagcaccaaaaaagaaactaatcagtctcctgactttcatatctggtagtcttagaatgaatgtcagaactgtcacaggtcaaataatggcccagtatgttttcaaataagtgacactgaacaccatgttttagaagtacatgattgtccttcttgatgttaatctcacaacttaaggacatgcttgccaaacatcataatttcttttaataactcatgtcagataaatctccagtggagacctatgctctggactccagacttatgccaagtagcctaattactatctccacttgcaggcaaaataggcatctcaaagcgaacatacctcaaaaagagctcttaatctcctactattctccccacttacccagcatcttccccattctcaccttctctcatcatgttcctcatatcaggaggtaatagactccatccttatagttatacagttattaagccacgaaacaccctgtttatacccttggcagccctatttttttctttaattatactttaagttttgtgatacaggtgcagaacatgcaggtttgttacataggtatacatgtgccatggtggtttgctgcacctatcaacctgtcatctacattaggtatttctgctaatgctatccctcccttaccccccaccccctgacaggcccttgtgtgtaatattcccctccctgtatccatgtgttcttattgttcaactcccacttatgagtgagaatatgcagtgtttggttttctgttcctgtgttagtttgctgagactgtggtttccagcttcacctatgtccctgcaaaggacatgaacacattcttttttatggctgcataatattccatggtatatatgtgccacattttctttatccaggctgctatcattgatgggcatttgggttggttccaagtctttgctattgtgaatagtgctgcagtaaacatacatgtgcttgtgccaaccccatcaaaaagtgggcaaaggatgtgaacagacacttctcaaaagaagaaatttatgcggccaacaaacatgaaaaaaagctcatcatcactgtgccgggtccatcccgcagaccctggctgagcaacagaagaaaggagtactcagacacaaatatacagggtaagagcaggctaggaggctgcgagccctaggggcagaggagagttagcagtctcgataagccagagctgcttgtatttattcagtactggtataacgtccaaggcctggagtcaacacaattgctgggtaattaacatttttgctccctcttacagggagcagtctcatgctcagaagttcaaaagtcagtttcctgatgacataagtaaacaagcatatttagataaacttcttcacttttccttgcacctacttctcacccttagcctcagagaaagagaattttcttccttcacctttattctctcatgaagcttttgcaagaccttccaacctttcaagaaggcttgcgtctttccttatagcttctcccaccaccctgaccgatctcccacatcactggtcattagagaaatgcaaatcaaaaccacagtgagataccatcccaagccagttagaatggcgaccactaaaaagtcaggaaacaatagacactggagaggatatggagaaataggaatgcttttacactgttgatgggagtgtaagttagttcaactgttgtgaaaggcaatgtggtgatttctcaagattctagaaccagaaataccatttgacccagcaatcccattactaggtttctacccaaagtattataaatcattctacgttttttttgacatggagtttcactcttgtcatccaggttggagtgcaatggcatgatcttggctcactgcaaccaccacctcctgggttcaagtgattcccttgcctcagcttcctgaggagctgggattacaggcacccgccaacatgcccggctaatgtttgtatttttagtagagacagggtttcaccatgttggccaggctggtctcaaactcctgacctcaggtagtccacccatctcagcctccctaagtgctgtgattacaggagtaagccaccattcccagccaccctcatttttttatagctcatactatgttaacaaattttatcaatagtaattcaaaacatcttcagattctgttcctgtctcaccaccatcactacccccctgattcaaaccaccatctctccactctccagttaggtttactgctatagccgcctaactggtcttcctacttccctgtagccccttgccttcagtctattcttgtttctgcaattagggtgattctttaagaataagtcagaccgagccattcttctcttaaaaccctccaatgacttcactctccatcccactcaaggtattagtttcctcaggctactgcaacaaattaccaccaactgagtaggttaaaagtacagaaatttattctctcacagttctggaggctaggagttgaaagtaaggtgtcatcagtctcagggtctctgaaggctccaggggaggatccttccttgtcttttcctagcttctcacagttgccatcaatccttggcattctctggcttgtagttacatgactccattctcttccttcatcttcccatactttatccactgtgtgtttttctaaatatccacgttcttacaagcacactagtcatttgataagggcccatctgaatccacttaacttgattgactaggcaagattttatttccaagtaatgtcatatttacaagtactgagagttgggatttgaacatctttttggggaagacacaattcaacccacattactcacatcccaaagctccttaccatgcacgcatctccagtcctttggtattcaaagtgtgatacacagaccagtagcaccagcatcccctgaaacttgtaagaaatataaactctccagaccacctgaatcagaatctttattttaatgtgaaaccttggtgatttatatgcaaattagaatttgagacacatacccctcaaaacgacctgcctacttttcttattatttcatctgctcctcactccatatcactctgtcattactctgcttgtgtcatattggcctttttgatattcctgtagtgcctggactattccttccccagatatttgcatgggttatttactcatctgcaccagatataaagatatagttattatatatagtgatatataattatacatatgttatcacacatatataaaacacagtgcagttgttcctggttaatctattttaaatatacatcctatcaaccccattcttcttccttgctttttctaattcaaaagtatttattttcacaaatttttatccacagctaaatattacagtgactattccaagcatttttctataaagaaaatctgtagtttacagatttgttcaaagtggaaaaatattttcatcagtagtctttcttccctggtgttaggttcacccctgaatatgttctgaactcttccggagaggcagtccttcatctaaatgtcagtgggtggcaaaatgttatattcaaatctggattattctgacacagtgtcacttcagaaagtagcttagtttcatttctggttgatcccctttgttagaattaggaatttaaaaaaaaaatcttttgtatgtaatgatctttataataataataaatcctgccctgtgtttgtcattggcattaacctctgtctacaccctctgattctctaattatggctccagtgggtacaaaaggtgaattatggttatttggctcatgcagcaaattaattggagaaactgatgacaaatagtctgtgaagaactacaaggtcttgccccatgctgtcccattttagttaccatttagttatgtaggcattacacaaatgcctcaaattaggacacctttgctgtctcagtaggtcgagtgtatgaaaatttactttatgcagaagaaataaattctaatttattggttaccagaatcttaatgtatgaaggttctaagtaaatatttgatgaattgatggtagcagcgttaatttttaaatgttccaagctcctagttttttcgttttgtttttacaaaagccttaaagtttggtactaaggaaatcaaagaatcaactaccaccatcatgcttcagggaaagggaaaaatgtctacctttgggtctaatctgcctcccaggcgagcctacaggtactagaactctaactgcaactatgatggcacagggaaaatgcatgtatgtaatatgcttgtcggcttcagcaacaactcatgtatacatacacatttactatatgtaaacaggtcccgtataatacttaaaacacaagtgtttgatctataaatatttgattcttagtatttaaaatgcttctaatgttttaaaagacaaaactccaccatgatatcacattgaacattaaaattattcccacagcaacacttttttcagagaaacaattgagaagtcagttatcttagtcaccactaaaggcacctggtgagaaaagcctgaactaaattttaaatattaaaaaattaaagagacatctagtgcagagttcaaacctttatgttgaattgtttaagagtcattactgatttcatgacgctgataagtgtttgagatgaaatgattttttaaaatgcagagaaaatgctaacagaatattatatagttcccctaaagatgcttcttctaacctccaagtattaaataagattgatctaaatgttaagtacatataaagtatatatttgctagtcatctataaattttaagtacaattccagtgatatacctgtatcttttggaagagaagaactaaacctgccgtttcttaggctaagtagacaattcataaggtccttccttccccatttattctgattgccaagcttttgttcagtaagctcttggcatctagtgattaaccagtgacagcagacagtagtgttccttgtgttccatatcgtatttgccatcctcaatgtcttccaggtgagttttgcagtgcaggactttcaggaagattttattcctgtaggacaaattaatgatagaaacacaaacaagagtaggaatggggaaggatttcagcccagaggaagcctcagctctaaagagcagtaataatgagaattcaatgagatggaaagaacacattcttctgatcctatggaacctcatgctttttatcacctacattataatttagtgccatttcccagtctctgctaaataccctgattacaccagtaaaaggaaaatccccatttgtctaagattatcttgatgcagtctattatctcctaaatgaaaatcctgtctttgtgaggacagggattgcccttttcttgttcatcactatacctctatgcctgatagagaccttggtacagagtaggttctcaataatcatttgaatgaaataaatcctatgtaccacatagcagcttctctggaaacatcaaaaatcaaagaacgaatgtcctgtgaatgccagacaatctgcttgattgtactacaatgcaaaaaacatcttctttgctctcctgcagcacgtaactaattacaatgcagaccagtttgttagaagaaatataacagaggtatagatagcaagcctttaaaccacaaagaaggaagtgattaattctgtttcacccaatggagaggtgataatacaggaaaaaacctgcccaaggattgaggccactgtgagcttgtgaagaggcagaggctggaggtgcacttgagatactgctttcaggatgcttgtgccaagaacatatgaaccttaatttctgttactgggcctgtgtctccaagttataaagttcatatgtaatgaccttcatgatatgcctcatttggaaggaactagttatcccaccccatagccaagattctcatcacaactatgtgaggaatattgtagacacaagaggtgtataaatagcataaccaacaggacctccagttctcaaccaaaggaaaatgggaaaatagaaaatatcctcctaacatcataacatttagagtcccttggtgtggaccaactgcctctcattgaacagtatcatgtactggactcattccataaactcagatagaaaaagaagtagtacaaatttaacaccaggttaatagtactttctcttttgctggacaatagactataattaaaatgcacttctttttaatctttttttctcagggattattcagtttactctttggatgcctctaggatctgaaggtaagagcaatgacagtttcatgtttctagaaaagcgtgaagtgcttctggcatgttgaagttacgatagcttctttttaacaatgcaggtacaggaagctttgctgaataagttttcattgtcgagatggtcttcaccacactcaaaggtaaaccttttctctgcagatacttttcgttttataacctcatgtattccactagcattctgaagtacagagtactaaattttttcttcaggattttgattaattaggctaaatatattgcatcctcaaacccatctccctcaacagctatatttggcatagatcattccattgtttttgcttctcaagtcattctgcctattaaacagagccatagagctgtcattgagatgctactccacatatttaaatagggtttaaaataatatatgatataaactgaaggttgaaatcaaatgttcaatgagaagcagtcttctggggggattcaaggcattagagaaaacaagttgaagaataataatggataaaattttctatagttcattgtggaacataactattgcccttggatatatctgactgcctttcacatgtcagaaaatactagaagcctaacaaacaataaaacttgtatttgacagttatttttctaatacagatgacaagattccagtattttaatgtgacctctgggagtgggactagagatgccggcagtgaccactagagggtggaaaatcaatccttctagggatgtaaacagctttggtcccacaaatttgctttgtgattttccctttttttctctcttctagtcaacatccctgggttcatccacacctgtgttttctatgagttctccaatatcaaggagatttaacagtttgtttggtaaaacaggtgagtagtggcctctatgttctccctgcttgcccagaacacatttggtcaaatggggagcctcaacacccctactctttcaccccaatcatggcatttacctaaaatgtcctcttttggggtagaggttaaatagaggaacttacattttcacaaatcaccaaaaagtgggtacagagggcagctgcctttgttgggaacttataataactcataaagaataagatttggagaatctagacaatgatttggagagctgtctgtcaaactatcatccatcaaaatgagaactgtaaattgctggccttgtcaaacacagagttcttctcaaattatgtcaaataagagtagataggtgatgtttcagggttacggggcagcaaagaatacagttagaaaatcttactacaggatctcactatttaggtttgttttccttttgtgttctttttataaagtgtgcttgtgttacacatggaagcacatagaagtgtgcatgcattacataagggatcaccctagttagctattctattagaaatattcacagttaaatttctaccttggagatttgaaatgaatggaattaataactttgggcaacagatctcagctattctagcaaattgaaacccctgtcccatgccaccatccctcccccacaggaaaataagccccaggatttcttctagctttttgaaactcaacagatctcacaaatgcagagttgagaaatgtatcaatgttccacattaaggcttttcatatacaagcaaattttgtgaatgcctataactgttaaaactccagaggacttgggttcttttctgcttcaatttgatgaattacccatgaaactgggggaccttcacttctgattatgaaagtcccaattgggcatgtttgggggccccataagtaccgtaactttggtttatgttgtcagcagcccctaagatccccccaggccatgacggaaactttgttagcggtggtggcggttcagcaatttgatggtagggtgggcacttcaacccttttcttgcccgacacacactctccacgcactccctgtgcacagtccccacctccccgcagacacaagcctgtgcagttgctcagaggctgccttccttgctgcactgattctcagcagttctgttgacgttcctgactcctgcttcttttctggtcctgccttttctctccctataattttctcttttctttccctttactctctttacaaacctccactttcagtagagcctccaggtgcctcccaagagcttctgtaagtcaccacaacccaagaggaccagggagattccctcatgcagatgttcccagaccatgcacgtgatggcatatggagggcttcccaccttgacatcttcccgtcctttgtagaaacctggctgctggtatgatgtgaagtagtgactgcttgttggctgccacacatgcatgagaacgacaactctgttagttctctggcatttctagctcttgggaagagggcaggtatgggttggtttccaggcatggccgagtttacctagtgcctagaccactgctcccctgggtcccttaggagatgttcacaccccaaagttcatgatggcttgtcttcaaggctgagttgctgctctgtttttcaggaacatataatgtttccaccccagaagcaaccagcttatccctggaaaactcatccagtgcttattcgttgctcaactaagaacaggataatccaacatacgtgacctcctggggacagtggatggatgtgcttttaaaaagagatccttgcaaagcaatggagaatgtgttcttggggcaggtttccaggagcagatgtcaaaaagactttcatagagaagaggctttcttttgtaaagacagactgaaaataattgttatgtttatgtttgttccctccccctcccccttgtgtgataccacatgtgtatagtatttaagtgaaactcaagccctcgaaggcccaacttctctgtctatgtaatatagaatttcaaagagacattttcacttcctacaaattgggcacaaagataagctttgattaaagtagtaagtaaaagacaacctaggaaatacttcagtgaattctaagaaggaaggaaggaagaaaggaaggaaagaagggagggaaacaggaagaaagggaaaaagaagaaaaagagaaagatgaaaataggaacaaatatagacaaacaacattaagggccacgttttaagatttccatgttaatgatctaatataatcactcagatagtgcaacattgagaatttttttttaatggctcaaaaatggaaactgaaagtaagtcatggggaatgaatactttgggcagtgtcttcctgatgtcttcttagctaagaggagaaaaaaaaggctgaaaaaatagggaggaaattccttcatcagaacgacttcaagtggataataatatttataagaaatgaatggaaggaaacatgattctcctgaggataactttgtatgttaaggtttgaactaagtgaatgtatctgcagaggaagtattataaagatacgtcattagatccaagtgctgattaaatttttatagtttatcagaaaagccttgtattttagttcgttccatattttgaaagcaaaaaatatatattttatatacctttcaattgccaaatttgatatatcgcactgaagacagaccctgtcatatatttaatggcttcaagcaggtacttctctgtgcattatagaatagattttaataatcttatagcattgtacattattattgctgttgtcactgttattgttactgtggataatggcccttggtgtgttgcatagctccctaggtattctctgtttccatctttactttcccagaccaatatacattaagaattttgcatggtctaacttgtgtttattccaaccacttggaaagctcctgaaaagaaattttacatttggctgttctgtgctcctaatgacacttgaccttgttgaacaaatggcagagactttcccaaggatttgattgtttgtgaattatctgcatgtgtgctttttttcgtgtgtatgtatttcattaaaaaatataaatacttatgaaaattgcatccatattagagttaaccatgtgctatggatacagcaaccctacattgcaaataaaagtctgatcccaaaaggagaataagacaaaaatagagatgtggggctacttaggatatgtgggctgtgtggcaacagaaatgggcccagccattaggaagatggggcaaaagaggctgagattcaacagccatttctttattgaggttcaaaggagttttcttttaatattttaaccctttaaaatatcttctttttatttttaattttaaattctacttaaattctacttctgcctctcttttcttcatggggaaggagaggtatgggacagaggtgggacagttgatgtaaatgaactctttatttctacatattcacaaatgacatagacatctacttccacatttgcctgagaattgtcacatcactgtcccaaatgaatggtgcattactgaaagtccctaaaggaaatcattgttatgctataaatgcatgccttgttcttcaggaatgatcaactttgggcagagcttgatactaagaagatggagacagaggttgggttgggggaaatcccttgaattagaattagaattagagaaagaaggcctttggctgatttggttcctggagttatatcaagaagaatcgagccaggcttggaacacaatgttagcagggctatcttgacatgatcaatcaaggaaagcacacagtatcaggagcaggatgtggttgtcatgttcaaaaattcagtgggacaagaaacgctgaacttccacccacttcagccaggatcccttggggaatcactgtgttcaaccctgtgaagggaactttcatcgtagcaggagcctgtgggagttacacaggatgtggatctggcccactgctccattcgttaactggggcatgttcccttatccccaacacacacaaatacacacatgcacacatgtgcacatgtgcacatacatgcatgtgtttcaccctttcaagccacatacatgcatgtgtttcaccctttcaagccacagcactgggtccaaattccagaaaagctatgaaagcaaataattggagaaacacttgctggttttctgcccactgcaatacaagttagcccagccactaccctttcccgggaaaatcctaaaatgaacagtagaattcaaaattgtagaacagcagttatgaagctgagaattttatgaatgcaggagcctcatttggccctgaggttgccatctctcaatcagtaatgattacaaggctattagtagcagattcctgagaatgaaggcacatggagttgtgcgatctactttgttcgtaaggtgcccagtgcttccctgtgttcctgacatctctcagtgtataaagtccattccctgagcctaaactttcttgcattaagagctttccattaagtcagtttcttgcaaagggctttgtcctaatgcgtcagagtctgtgaggttagaatattcacaaatgagaagctaatacagattataggaatattctctgggaatattctaagtccagactaacacatcatctcttgagtaagccagatgtctgctatcctcctcccccacttcttattgtttgcatggggaaatggttaaataaatgtctgtggggttttcaggtttttgctaaggccagaaattaagaaagactgtgggaagtcacggccttttgtggtttgtatagagaatttcaaagagatccatgttggaatgcttcagagaaaaaaaaagttacatggagctgagaaagattacagtaattagtaagtatagaaaggacgtgtgggtgagttattgaggtgaatggagcaggaagtcacaatcatttgaagaaaaaaagaaataggtggtcctagaaatgccaggtaggtggaatgcgtttattttgtgccatgtgatggtgaagtcaaataagccctcctcatccaaaagagaaaacccagtgacccaggccagtaaaagactgattttttaagtgtccaaaatgaaggtggaacttacagggaacttacctcttgatagcgtttttaaaagggcaaccggaatagcatctcatcatttcgagaggacagtagtttagctttaatattaggttctgttggtttctaaaattatcacttgggatttaaaatcacatcatgtataccagcacacaaatatgcttcctttccatactataacaatgaaatatctaatgagatctcgtgagctgtcttatcgggggacctgccccgataatcacataggttcttttctattttcctaagtgtcgactggcttgagaaataaaaggacagagtacaaaagagagaaattttaaagctgggcgtccagggggagatatcacacattggtaggatctgtgatgccccacaagccacaaaaaccagcaagtttttattagggattttcaaaaggggagggagtgtgcgaataggtgtgggtgacagacatcaagtacttaacagggtaatagaatatcacaaggcaagtggaggcagggcgagatcacaggaccacaggatggaggcgaaattaaaattgctaatgaagtttcgggcaccattgtcattgataacatcttatcaggaggcagcgttttgagatcaaccggtctgaccaaaatttattaggtgggaatttcctcttcctaataagcctgggagcgctatgggagactggagtttatttcacctctgcaatctcgaccataagagacaggtacgccccgggggggccagttcagagacctacccctaggtgcgcattctctttctcagggacgttccgtgctgagaaaaagaattcagcaatatttctcccatttgcttttgaaagaagagaaatatggctctgttctgcccggctcaccggcggtcagagtttaaggttctctctcttattccctgaacaattgctgttatcctcttcttttttcagggtgcccacgtttcgtattgctcagacacacatgctgtacaatttgtgtagttaacgcaattattacaaggtcctagaacgatatacatcctcctcaactgacaggattaagagattaaagtaaagacaggaataggaaattacaagggtattgattggggaagtgataagtgtccatgaaatctttacaatttatgtttagagattgcagtaaagacaggcataagaaattacaaaagtattaatttggggaactaataaatgtccataaaatcttcacaatccacgttcttctgccatggcttcagcccgtccctccatttggggtccctgacttcccgcaacactgtctctgtagtaattgtttgccttcttgcaatgtggtgctgctgcctctcaggcttccgcatgtcacccagaatgcagctctattctccaaacagcaaacgatcctttccatcttccaggtatgggggaggccggcagctcgcccctgagctcaactggctggcagggctgatggcttccctcacaccatccgcactcccaagccgtgtgcaaagatccagcacgttatagaaggtttaaacaagggtccttgaagtaaagttttcagaaccagttgtctggcgaacaaacagatgcctgttccaacatttgtgtgaggatggcttgaaattttcattgacagctgaaaatagagccctcatgtcctatagattaatataaaggatgtgagggctctatttatcctctagcacattctagacggaaaccaagtttcccactgttagtggacagaagaagaaaagaggggagatgggccaactcccgaagtccgctctatgccagacacaagttctgatctccaaatatcatctgtatgtgtctggggtgggcgtgggggccttggtcgtggtgtcctatgattcagacacaaccgtcctgtctattcttttttttttttttgagacggagtctcactctgtcccccaggctggagtgcagtggcgctatctcggctcactgcaagctccacctccagggttcacgccattctcctgcctcagcctccggagtagctgggactacaggcgcccgctaccacgcccggctaattttttttttttttttttttttttttttgtatttttagtagagacggggtttcaccgtgttagccaggatggtctcgatctcctgacctcatgatccacccgcttcggcctctcaaagtgctgggattattcttaaatgattttatacacacccattttcccccttttacctgtaaactttgaaatgaagttgaaaggccaccagtgtccatgacaggtccctctgcacacatggtggcatggttaggagatacatgagcctgttcccaccccagggtttttattctgtcatgcagagccaagtgaaggatgccggtgactattgaagcctaaacagaacaaacccaggagcccggggggaaaaatggctttattctcagtatgaaaggcaagaggacctgattgggcaagtggtgggcagattgctgtcacggcccacttccgatgacattaaacaacaaaacccaggaatgactttggaccctgcctttttcggattttgattggtgccatcctggttcttccatcctgccagccagccggcaccccagcagttgtgggaaaaggaatttgactttgattaactgagaaaaactgtgcatgcgttttctgttttttctggaactgtgagggttttcctatgccccaggggctccctcacagctgtcctatcccaagcattcccgacaggaatctccagctgggttggagtgacagctggcttccagcaccgcagctccgcaacccctgctggcgtctcccgaggctcgcgcgcccctggtgggcgtgagaagaggcgtccccgcggcggtccggcctcaggaagcccgtgggaggcagagtcagtcccgcggatgacgcgcccagtgggctacgttcaggaagtcatttgatcatatgggcagagcgaaggtcaaggcatagtggataacagaaaccagaaatgaaaaaaatctctttcactcccgcctcctaactttcatattatgatccttacaggggaaagggtagtcagaaagccacgtaggactgtggagggagggaaatcccagtcacgtcgtttcagtgtgtgaaaggcaaaggaaatttcgggcccccaatcactatgcaaaaaggaaaaaattaagatggaagctgagccatgcaagaaacagccttttccttctattgctaagcaaatagctaacagatgaaaggccagatatctccacagagagctacactaggttcaccttttatgtaaagtaccgatttactgagatgaatacatcactgactattttcctacctgctccttttctcctgcaatgcatggattatgccatgtgaccataccctccctctttcgcctccacttttcccctttaaatactgaaaccttcaaaatatctttgcagaaagacacagaccacaggctgtctctgtgattgtgtgttccattattccaggcatgttcttaaccttggtaaaataaacttctaagttgattgagacctgtctcaaagactggtttacaagtgtgcatagcacatctgcaggcaggcatacatttctgaggcatactcgctgagatagctccttcctttctctgtccccctcttactgactgaatctcatttatggcactaacagcaaagctgaaagccccagaaaagatctggttcacccattccagataggctgctggaaggtcgtttgaggaagaaaaatgggtgccttccatatttcatgttaacccaatactttttccatcaaggcagctgcaaaaggattaacataggtggtcctattccctttcctaattcatccattgaaagccactgctggcctggagtttcattttcaatccatcatgaatctgcagatgaatctgcagctatcccagggcaatctgacagtccagccagcagctgaggctggatggcaagttcctatcctctgagcacacattgctaacgtgtgatccgagaagacccaggagaagtcaacagggccaactgccggcagggttggtccttggtgtagagggacaagctgaactggccttaagtaatgaggcagacagcttcccagtttggggggatgtcacgcaccttggcctgttgctcctataccctcggaatagctctcacaccttcttcttcatgttggacattccttttacaaaaacagaaatctcaaagacagataaagttaagaaggttaatctcaggttaatctcaaggagagaaaaggtatgcaaatacacctctgggtgagaaacacagtaacttaaatttaccctcgaatgaaaatggctggtaactatataactatattaaccaacattttttgagccctttctgtgtacctgctgctgttctaagatttttatgcgtataatctcatttaaactctatagcaaaccaaaagtaactaaatattctttttctttgcatttttagaggaaaaaactaagcacagagaggtaaataacttgcccacagtcacacagctgaggaccagtagaatcaggatctaaatgcagtgtctgacctagaacatgggcatgtatccaccaccttatattgcttctctatgcaacctgatgccagttacttgcttaaaagtaggcttccgtagcaggaagagtttcaaatgcaaaaaatgagagggagaacaacagtgacagagaggttggaggagttaagccttctccaagcttcatctcactttataattctaccttggggcagcccaggacataatgaccaatgttctgggcaaacttcagagtgcgcctacttcctttttaagtctctggtgaaacatcaaagaattcctgctgtgctgctttattgaaagtagatctcaacttagttatctagtggaccccccagcttgagtcttcagtcaagtgagcttcttgtaaggtctcaatcaccagtgttgtttttatttttgtctcagatctatcaagaattctcggcgtgttggatggcatttagacatgtaggaaggcaatatggcttcccagaaatgaagcgtgattctgaggctatgtttaaacatatcaagtggagaattgggacatttgtcctaatacgtttagctaagtcatgattttccttctgatatgcagactgaaacagcagctgatttgctacttgaatgctttgcattctctgcttcattttgcatggacaggggtattgggctgttcttcagcattgattgacagccagtttggcaaatgtggtatggtggttaacagcattggttctagagccaaactgtgtgcttttcagttgtaggtccaccacttcttagtttgactgttggtaaaataactctttctgcctcaatttacactatgtgaaaggaaataataatggtacatgctccatgggttgttgtaaaattcttataaagcctacaaaatcatatctggcatgcaattattgctgaataaagttagcctttattattttgcatcttactgtgtgtgcataaaaactatagtagatatatatcatacacacatatatacatcatgcatcatgacttagccaaatttattagagcaaatgtttcaattctcctcctgatatatttaaacacagcctcagaattacacttcatttctgagaagtcatactttcttcctatgtgtctaaataatatccaacactcagaattcttgatagatcttgacagaactcagatttagatgccagttctattcagaatcaaactacatatgcctttcacattgtcacttttaattcatggttaagagcttttgagagtaacgtcaaaggtacgtgacatcctaaatcataactttatcaaggtttgagtttaaatcgtgctcattatgaagccagaatgggtgagtaattcacataacaagtgtgtgagcctggttaactaccccatgtctgcatttcaaatcagttttggtaatcttacatattacataattttatttaatcttcaaactaatttcattatttcttttctttacaaatgagccaattatgcactataacagtggtgttaattaaggctttctcagttacaggtaacagaaccacaatcaaattagtttaagcaaaagtgggcacttaccacgtaactgggaaagatagtagattggtacaccttcaggtacagctagattcaggtgcccaaacagtgttctcagagttctggctcttccttttgtgttgtttcctctctttgtgtatttatttcattccaaggtagatcttcaaggagaggaatttatgaggtccacagaccgatagattgagatttaaaaagaagactaacccttttcttctccaaatgttcaggtatatgtggcagtacagggtatcatgattggcttagtctgagccatgtgctggccccatagaaataattatatccattaggatcatgttttctgtgaatgccagacattcaaaataatagcgacttaaagtagaagtttatttctctaacacagataagcagcccaagactggtgtggcagcctggctcggtgcagtcctcagaaatccagatactttctatttttttaatctgcttttgccaaggtcaccacgtggccccatttggcagctctcactctggccattacatccccttatcagtcattaggatagaagaagggactacaggtgtgcaccaagactcctttaggaaaggttcccagaagctcacatgcaacattccttcttccattccactggcctgaatttgatcacactacctcactgtatcagtctgctttcacgctgctataaagaactacctgagactgggtaatttataaaggaaagaggtttaattgactagcaattctgcaaggctggggaagcctcaggaaacttacaatcatagtggaaagcaaagcggaagcaaggcacgtcttacatggtagcaagacttgaaaagtgagagaacaaggaggtgtgccacactttaaaaccatcagctttcatgagaactcactcactatcacaagaacagcatgggggaagccacccccatgatccaataacctctcaccagttccctccctccacacgtggggattacaattcaagatgagatttgggtggggacacagagacaaaccatatcacccatctacctgcaaaggaagcaggagaaggtaaactagactctgagtagccatttgaccagttggagtttggggattctattactgagaaaagaagaatggatgttggtgaccatttttgttgggggctgatatctgaacatctcctctgcctcctgctctcttctcatacctttcttatgaccccatttttctattctccttttattctcttgaccagataggatctttaaatgtttttaatgattttcattgagctggtgagccacacatgggtcaatttgtcctaaatttgtctaggccctgagggatgctgtgacccagatgaggcccatgtctcaatccattctgggattccaggactagtccttggtaaaattgtggaaggcaaagagagatgggtcttgtctttactctgatatcactgttagctgcaactcttacacacacacacacacacacacacacacacacacacacatcctgttaggctgccttacccatatcaaatctttcctatcatattttttcacatcagtactcattagaggtcactggcacctgactccattatctcccatcccccattcattagggttttcaagagtctgctaaatgacactcacagctacaggataactataaatcttttcaaacttttctttgcttagagacttttgaaaaacatacttatattaaaattggcataagaaagatgttttagccatatttataaacatatagaaatttgagtaggtgacaaatcatccataaacctgatatccctaataagggaaaccaagtaaaaaagacctttacatagtgttcaatatagatttgcctatattttatagcaccttccaaacctctaatcttattaaggttttctgtagtcaaacaagaataatagattctgctattaagtggctctgtgacctgcctaaggcacttagcctctccagaattgcctcagtttacccaaatacaagaggtggacttcagaatctctaaaaatttcatcaagccataaaacagatgatataattcatgagaaaggaggagctcaagaagggaaggtgtgagatcatctgtaatttgcttgtaaatgtctccatataggtattacactgtatacagcctgcagggggactataatccacaccctgggggaggttaaatagtatgcaaagtattctgaaaaggaatacacactccaatagcagttagttagtatttgaaagatcctaatcaaaagtctctactggagaaatatctgttgcaaaactttaagtatttctatagcaagctataccagagggtttgttattagtataaaggatgcttaaaataatttttgcattggttaaatacaattatcaagatagctataggtacaatactttggcaggcccagtgaactaacttttggggtagaacctttgactagaactctatttggtcctagttttcactcacttaatacaagttttcattggctcatccaactagagcagtgattcccaatcagtaatgattttgccccttgggggacatttgtcaatgtcttagagatttgggattgtcactactggggaagtgtgctatgagcataaagtaagtagaggccagggatgccactaaacatatcacaatgcagagaacagccctcacagaaaagaatatccagctcaaaatatcaccagggctgaggttcagaaaccctagggtagagagttgactgatcctggccttcagattatttgaatgcatgtgtgtagaatgaacctttaatccaagaggcttggtggtggagcacttaaaaggacagagcagagacttccctacacatacaaaacaggttggatggctatttgtgggtttgttggtttatcgggggaaccagactccaatatttcaatgcaagttctttctattttccctaagtgttggctggtctgagaaataaagagaaagagcacaaaggaggaattttacagctgggcctctgggggtaacatcacatattgggaggtccgttatgtcccctgagccacaaaaccagtaagtttttattaggattttaaaagcggagggggtgtacaaacaaagagaaggtcacaaagatcacatgcttcaaagggcaataaagatcacaaggcaaaggcaaaattagaattactgatgaggatctatgtcccactgtgcacatactgtcttaataaacatcttaacagaaaacagggttcgagagcagagaaccagtttgaccaaaatttaccaggctggaattttccaatcctagtaagcctgagggtactgcaggagaccagggaatatttcagtcctcatctcaaccacataagacagacacttccagagcggccatttatagacctccccccaggaatgcattccttccccaaggtattccttgctgggaaaagaattcagcaatatctctcctacttgcacatctgtttatatgctctctgcaagaagaaaaatacagttctattctgcctgaccctgcaggcagtcagaccttatggttatcttcccttgttccctgaaaatcgctgttattctgttctttttcaaggtgcactgatttcacattgttcaaacacacatgttttacaatctatttgtacaatagtggtcctgaggtgacatacattctcagcttatgaagataacgggattaagagagtaaagacagacataagaaattataagactattattagggaagtgataaatgtccatgaaatcttcacaatttatgttcagagactgcagtaaagacaggcataagaaattataaaagtagcaattttgggaactgatacatggccatgaaatcttcacaactgatgttcttctgccgcagctccagctggtccctccgttcagagtccctgacttcccacaacaatggttaacaaatatgaatgtgtagcagaatttagttcaaatcttgattcattttaacataatcagagagggggttagagttcccatccacttctaattatcagaggctccagatattactgaaagaacctgacatttgtgaatggccagattggctcagctcagttcacagaaggaaaggatgcagatggggatgtatcaaggatatggtgtgggaagcatgagacattttcaaaatttcaagccactatgacttattcccactatgtaagattaaagaagtcagacactcagattcagggaggatttcccacatttttcatgttgctcatctaaatcccaaattccatactgcctagagattatgaaatgcttaatttctacccactccccatcctacatgcccactttgccatcaccatcccaacacctcaaaagaataaagtatctgctagtcctcctggaatgattgagggtttgggctcaaagaaaagctgaataccatgtcagatttatggtgagccagatcattaatcaactgaggtgaccattaatcaccaaaagtgataaagatagatagtaggcatggtactggttgagaatctagagagaaataaatatcaaaatgctttaccctcattctggtacctccttatcattattttgacctagcagttttaatttgcagtactagatgaaaatactaggttatctttgaaatttgagcttctgcttcttccagagagaaactcatatatttaagaaatgttgtcattggtttgggctagggacctttccatgtgagacagaccacagcatgttccttttaataaaaccaaaggacaataacagcagcagcagcaacaaagcctagagttcacttctgaggtcagatactcagcagagtgttaagggcatagctttctttaggcctaactatgaggttagtggagggtttgcaggactgtgaagcacagcgagaaacaaagctggaatccatttccaatctggactttggagataatacaactgggctggtgacaggatagcttcctatctagtctgaacattgaatagtaatattttcatacatattaaactctaagataggttcatattcattatcccattgtattactctgctactctgtaagtagtaaagtcatgtggaaggagatagtcagctattatttccatttgacaagttagtaaactaagatcaagagcttaaatgatttcttactaaaattacccagccagctggatgggcaatccaagcctgcagccaggatgcttggcttccagacttgttttctatccactagagcagtggttctcaaggtgtctgtgaggtgggggttgtgggggagtcagtagcagtagcagcatggcctgagaacttattagattctggcacattcttataccttgttagatcctggcacatttaagaatgtacattcttagatctcaccctagatctactgacccagtttctacagaggacaggaagatgtcaaggtgggaagccctccacatgccatcacatgcatggtctgggaacatctgcatgagggaatctccctggtcctcttgggttgtggtgacttacggaagctcttgggagggacctggaggctctactgaaagtggaggtttgtaaagtgtggggccctgtaatctgttttaatcagtcctccctgggatacagatgcacctcaagtttgagaggtattgccctcaggggtgctgttttcacttgctacaaattgttctcatacctttgcattaaagaaactcttgttaatctctcattttgtttccagtgcattttaactctacaaaattgtcataaagtctctacttaggaaaccttataacttaaaggaccactcagaatccttaaaatatttttgtttgttaaatttcctgagctgactcattgctgattgggtatagaaactttagctttttttttttttttttttttttttcacttgatctatcttggaacttccttgccccagctagatttttatctccttaggaactatggaaagaaagcatatctaaaaatacttctttaaagttctctgataccttctgtttgttaatatgataatgttgtacataaatagctataaaatatactgttaaacttaaaagatctgggaaagagcttttgaacacccccaaccttcaacacacacatgcacacccacacgtacatacaataccagatacaaagaaggtgctaactcaatatttattaaatttattaaagggcttctcttagaatctcagaggaaagcaaatgctgtgaagccgggctgcctggaagtacctttatttgaaatctttaacaagatcttaaaagagtaatgacagtactgtgtctaatgaaaaatgagtatttgattctaacatattcaacataagaatttcataatatatatttgatctgcaatataaatgagagtttctatatcttattcattcatttattgttttattcattcaaccattgttgagtgcccacaatgtgccagccatgcatctaggcacgtggccagcatggtcaataacaacatgtgcctgccctcatggggcttacagtctataggaaagacagtcaatcaaacaagtggtttacaatgaagtatgatgaatgttgtcacaggacacactagatacattaggagcacatagcagagtaacagaattatgtggggcagaaagatgacaagggtcacacatggggctggaggccttagaccttggaggtcctatccaaagcaaggctgacaaaaaagctgccccaaactgcactgaccattggaaggtaaggcctgcatggaggaggtgctgctgtggtctggccaatgccaacaggcaggtcacttccttggcctttgggaaaggatggcaatgatggagaaggtcaagaagatcacaccagccgtgcctccaatcaccatgcccaggacgctgccgtgcaactgcatggcctgacagcgctcccatttagaagaaagcatgtccagagatgcacctgagggaaaaggacatgaagagagtgtgggaactcccaggcctcaggtgcctcctagcaacactcatctccacagcaataaaaatggcaaacgctcactgagcaggtccacgtggtgcctggtcccatttcaagtgctgtatatggaccaactaatttaacccttcaacaacttttgaggtggaggctattacttggccattctcatcatcttcatcttacaggaaggttaaataatttgctcaaggtcccattgttagtaagcatttcacacttgaaatctaatcccaagaggtatgcctccagatccaggcttctcagccacctaggattcaggaggatggtctgagacacttaaaggaatacattgcctgacactggctaagaatacaagctacaaaggaaattccccagatacagtctgacttagagcatcagtggtagcttgaaaacgtctaaataatattaaataaaatgttactgtaaggttagtgtgtactgtcactatctcacaaggttgccctgaagttcacctgagataatgaggacactgtacctatcaaggtatttgacacagagtaagcacataatggccagcccttagttttgtttcttaatgttatctggtataaagacgaattaatctcataaccaaggcatataacttgtagtgtctcatccatacctttgtaaaaattccagcctttgtttcaaacattcccactagaaggtctactcagcagaattctacaaggcagagtgaaacaatcagaagtcagcattttctggctgggcatggtggcacacgcctgtaatcccagcactttgggaggccaggtggatcacctgaggtcaggagtttgagaccagcctggccaaaatggcgaaaccagcctggccaacatggtctcatctgtattaaaaataacaacagcaacaacaacaaaaatagccagacatggtggcgggcacctgtaatcccagctactcgggaggctgaggcaggagaattgcttgaacccgggaggtcgaagttgcagtgagctgaaattgtgccactgcactccagcctgggtgacaagagcaaaactgtgtctcaaaaaaaaaaaaagaagaagaagtcagcattttcttttactaatcctgaatgattttaccttccaagtcctcatctctatcctgagaattgacttcttagaaatcagtgagtaatagcaagtttatttcattttttttctgacccagtcccctccaaacacaacttcgtaatatcccctactgttatcttagaaaaacttattctgccaactctcagctgcaggtttctaggagaggaatagtttggctgagtagaggctgacatacaagtggcaaccctggcctcccttagcctgggaaggatgaagcgtgttgggggcacacaatggaatctggcatctaaggacctgtcaggcaaagatatgaagacccatggctttggagcccagaaacagatgggccttccccagtaaaaggagccagagggcttcttggaagagtgattgattctatgggtggggcaggaaatataaaagatgagcctagagcatgctatggtgccagaaagtaacattgtgttcataaaatctgatgttgaaagatcacaggagccaacctggaagagctcccaaaggccaaagctgggacaatagaagcaacaaaataaattatgaaatcattgcaacagagcccactgaatcaatgtttatgattcctttgtgatatacataaacaatcgcataaacaaattaacggggtgaaggggccattcttctttacagaagaattctaattaatgaatgtgaaggacataggaaatcaacattagaagatcccagtggtgagtattgcagcaggttgtatcaatagatgctgaaattagcatgtgaggatttgaggaaaagcaggatgtctcaatggtcttgaactatctctcccaagatatgtatcaattacagagggagaaatggtaactcttcagtggagaggcctggtggacatgctgttggccagatgatgaaggttgacatcaccagtaatgacatgtatcagcatcatgtacctgctcacatgatgcaacaagaaggcacagcacatatttactaatcttgccacaaatgtgaaacctcaatttaatcatgagagaacaagatgaaccaaaaaaaaatccctaaccagtaatcttcaaaagtgtcaaggtaatgaaagacaagaaagaactgaggaattgtcccagattggaggggattaggagacaggagacataaaaactaaatgtaacgtgagatccggaattggatcctgaaatagaaaaagaacattagtgggaaaactgggaagagccgaataaggcctgtaatttatttactagcattctaccaatgttcatttcttggctatgctaattgtactatggtttgtgtaatatgccaacattacggaaagcagggtgaatggtatagagaaagcctctgtagtatttttgcaaggtatctgtaagtctaaaattattgcaaagcaaaagctacaaaaagaaaaaaaaggagactaaaaagaactcagaagaaatgtaaatttttgaggtaggcagaatagctcctacatctgctactgttcaaatggaactgttgcttctgtcatcacatacctccttttgtgaaacagtttttagggttttatgcaagcaaacattgtaaaaagaactattaaagttctttttaaatatttaaatttaaatatagcaaactgtactgctttttaatatttaaacattaaatatagcaaactgtgctgccagacagacctagatgcaagtcccagcttcagcattttccatctgggtacctttcagataaattacttaacctttctaagcctcaacttcttgatacaccaaatggggataaggagagcccttatgtcacaggtggcagtgagaatgaatttagatcatgcgtgtaagatgctcaggagaccacatgatgcataacaaggggtcagaaatatcaggtgttcttactactattattgaaaacataactttaacaatagtgcagtgtaaatgacagactgtataactaataatcattaggagctaataataacatctgcgtagtcagcaaagatttaagcttggtcttgagacccactgtcatggagtagaaagtccctaggctagaagccatcttggatgttgttagagttagaaattccaacaacatccaagatgctgttgacaataccccagaggaggaaaaggggtgaaagtcaagagacaaggagacctgggacgcctctgtcctggcagcgtaagcccatgaatccagggcacacctttgtagagtcaaggaaaactgcatccagctgaccatctgaggtagtcttcgccctactctgcaaacagcagcctttaccaggcataagcatgcacacggcccaggtctgctggcctgcctgtctccccagccacagagcctacctgcacctcgccacccacttcaggttcacacagatgccatcattttggcaagggtttgggtcacatgggtctctgaagtactgtggccagttatggtcctccagggggcctgtgttcttcactgacggcttctgtcagctgggctgcccctggctgaggctgacaggtacggcttcctctaacatggcctttcctgaaccttctttggagacctgctgctcctggccttggagaatgaggccttgggggctcagtcttttgcctttagtgggaacttcagtctggctgaggtgggtgatatcttcaggaaatagagggtcacgaggaagatccaggattagtaactgactacagcgaactcccacttctggtgaaagttccccagcctgcttctatctctagtgatatgtcacccccagtgacatggaaaagtggctttgaatccagctgattcccacggtactagctagttttattttaaagtaatccagtcacatttttatttattgaatttgcaaaatgaagcataaagttagcatggatagactgatggaaactaaattgaaatcagtgaactgttacctctgataaaattttcaaaaagatgacactaaaatttcagtttctttcagggacagttaaaataaagatgtgcgtccttgaccaactgaagaaaatgtggttctcctacaacacattttttttaacctcatccccaccctccatgtgtgctttaaaatcaggataaaatcagtagagtgccaagagcataggattatttactcaggaagaccaagaaaagtactttcaaagtccacaaacatgatgaggtcatcatttttcaggaaactcctccttttcagcatttggtgggagatgaaaccactccagccaaagtcaatgcttctaaaacaattacagtcagcatgataggttcccaccctggacggcctgtcccagatgacagtgtcatttgtccctgcaaaattgtaggtaacataaaatcacattacctctttagacttcgctttccagtttgtcttttatgaggatacagggctttgtgaatcagaaaaaaataaataaataaaaataaaaataaaaataaaaaaatgttggaaaaaaattaagctatttactctttccaggagaattgaaattcagaattgaaagatgggaaaggcagagaatcacagctctgagtgatcagttgtctgctactgcgtgatttttttaatgaaaagagagggacagctatggcttctttcttctgaggcttaggtcttctcttttgaaaaaaaaaaatagtgccaggtgtggtggctcatgtctgtaatcctagcactttggaaggctgaggcaagttgattgcctgagctcaggagttcaagaccagcctgggcaacagggtgaaaccccgtctctactcgggagtctgaaataggagaattgcttgaacctgggaggtggaggttgcagtgagccaagattgcgccattacattccagcctgggtgacagagcgagactccatctcaaaaaaaaaaaaaaaaagttttcccatttctttactgatgtaagtttatttcatgaacatagtgatattgagtgctattttaggagtaagtacattagctctgcacagagcctagcaagttccgagtatttgataaatgattagcagtatctgtttcctcaatcacaacgagctcaatgaggcagggatcacctgattcacttgtattgtaagtacctagcacagagtttggcacatggtaagccctcaacagatgtttgatgagtgaatttaggaaagggaaggaggatgtgatggcattgaaaatcttaacttgaaactccaacacgcctatgttatcggtattcccaggcggacaatgtgaggagaatgttactctttcttgcaccacagaatcacatctgtgggcctctctggttcgaggggcagttcttatttatgccgacaccacccacctggagatatgtgcaacttggaggtagtgaacaccaaacttgaggacatcctgttcctgacatcaggctcctggtcgaagatggtaattatcacctgtctgttttctaccggccactccaggatagcatcattctccccactgcacacgtgaaaagcaagtctcaaatagccagagctttctctgccatgggggtataaagttaacccaaaaccgcatccctctgaattgtagaatcgagggctctgaagcttgtccccttcgctggtgttctcaaggacctgggagaaattccggactgtccagacccctgtggggcagggggtttctgtcagagtgatgtcatccaggtaaattcccccagttgagttccgagggtcgccttttgtgccctggaaaagttagcgaaatttctgttcctctttgagtaccacatgggcaattttccaattatggtcatcatctcctgaggacagagaacaaggctggtgagaattgtggccaacacttaatgagtacttattatgagtgtggcacagtgccatgtgctttccataaatgatctcattaaatccccacagcagccctataaaataggtactattatgaactggttaagtaacttttccaaagttacatatttaataaggaaaaatggttttttaaaatactatgatttattttaaaattcacattcaaatcttaaccatgaatttgttttccactatcactataagaatccaggttctgaatttcctcctgagttggctggttcaactgtaacccctaatgttagcaatgaaagcccattaggctgaatcgtataaaatagccattttgtaagccaaaagtcaaaaaataataactccatatggtcccacctgtcacttgttgccagagaggtataaggaatgctgaagagcagataataacctgtaggactgactggatcttccctacctgaaaccgactccctctccaacatctagacttttttctcttccttatattatctgaaagttcagcatgtagggcagtgaagtaagccaaagagagtactattgtctagaaattcacattctaataaagattaggtctacttgctttttctctgagcatgaactagaagtgggacttttgaattaagagctgaggaaagatggtgagaaggctgttctagagcatgggatcctgggttgaacagcagaagaagccaggcaggagcttgggggcactggagagaggaaactgaaagcagagcaactcagttccgcaaagagatgcgcctacactgatatttttgcacaggacattccctagagttgggcttgaagaggagaggaaaaatgcttccaagtggaagtcacgttggctaaactgagttcctacagatgagtgtcttttttccttcttctgtgtcttttaaccagaaatctactgacagaactatactttccctgaaacagaaaagacctttaatctccctttgttttcagaccattctctctaaggacttcaagggacaggtataccaatgttatgtttcctagggtggagctgattatggcctgtgtggttaggttacatgggaacataggagagaggtagagaaggcacacgaccacctctgtaacatacaaatctaggtagctgccatctcctggggagagcactgcaacctactggaagacacatggacttgaagggtaataggtgccagaaagtctaggaataggaacagagatacagcatttgaactatttatccagcaggttatagatgacgggaattctgtcaagagaataggattccgttcctgctgatgagtacctgctttgttttttcttaatataggatgtccaaatgaggttgagatgggggaatttggcactgggaaggagacccaagagggtcacataaagaacactaagtgatattcaactaacctttttgaaaagtttcattgacaaaccagtatcagaacagactactttaaaaatcctttcatacagtgttcccagggacagtacacaggcatactctgaattcaatgaaaacacaaagcacagcagtgtaagaaactaatcatgggatgttcgcttgattttatgctttgaagtaacactgagctttagatgaaagtgagtgataataggtcccatcaatattattgaaactctaactcatttgctcattaaatatttacaatccttggtaacataacacatcctcaactcttaaagagtatctacctgtcatcctttcatcatataaactatgataaatttcaaccagaaaagtgaacccctcaaaactgtgatttgtagagttcccaggcagcccagagtgccttggatataggcgatttgggaacctgttcttacaagtgacctctaaggaaggtttctccttcaagagcagcagatatataaaaaataattcctttctctggactcatttcaactgataaatgccaaggtaggcagttggatgctaggataatctggccataaatcatgattcagggttataaacaaagtgtatgctttattttgttgtggtggtggttccttcataactaggaaaagggagacaagctttcttacttttcaacaaaaagtttctctatctataatcatttacatgctgaccttcttatataaatacacaaagtgactcttaggaacatgtaaatgattataggaagttaacatataccaatgacttatttgccaccaacattataagtaggcttctagttactgcagcatattaaataatggtatcatttgtttttctgaaacagatgcaaaacactgtggtcaattttttttttttaagatggtgtcttgctctgtcgccaggctgcagagcagtgatgcaatcttggctcactgcaaccacattgctaccactgtagccgagctgtggtctctgatgtcaccaccagctgcagcgaggtaagccacggaggcgcaggctctggctccagcctccagcatgcagcggtgtctcttccttctcctcgtcttccagcccggcaggagaagctcccgctgctagcctccctcctaccgctccgtcaccaacaccaccaacagggaggcagcgccctaggctccaggctccaggctccagcgggtgaaaactaatggacccttctagttctctaacccaggtacctagcagctgagcacaccgacacagaagacccaaaaatgacgcaccacttcctcagcatgctttatatactgaagttacggatcctggactacatgttctgattggatgagagaaaaacctctaggcctactctgattggactttattttcatgctgtgattggttatcttaagacttgctctcatgcaatcagaacatgaagtctaggaaccggcatgcgcataacctccgtatataaatgatgctgaaaagctgttacggttttttttttttagggttcggtgttttactgttgagctgctcagtgcccagcttagaggaccaggaaaaggagtcaccggccatatgctggaggcttgagacacggcacagcggcgcagctcgcctcgctatggttggtggtggcagtggagcttgcgattgccacgcggctggaggggtaggaagaggaaaatcgttttgggatagatagaggggtgggtaaagagtttggttattgccaaagggaaaaaaggatagcgaggaggagaaggcgttgcaaaaagacgatggggaaaagatggtggggaaaaaaggttttgggtagatggaggtggaaagacagggtgtggagcgggagtgagggaaggttttgcagaaagacggtggatagaaagtttatgggtggatgaagggggaaaagatggtggcaattggggaggggagagagtggtgaggtgggggaaatgggctagcagtagggagagagggttttgtgaaaagacagtggggagagaagtttttgggtagatagaggagcagaagaagatagcaagtgggagaaggaaaaagggtaactagcgggaggaagacaaggttttgcgaaaaaacagtggcagaaaagaaagatggtggcgaaaagacggtaggtaaaaagtgtttgggtagatggaggagggaaagagggtgacgaggaggagaaaggagggtggcgagaagggagcagggaaagaagggtgggaaaaagacgggaaaatagtttgggatagatgcagggcaaaaaaaagggtgacaagcaggataggggagagaagaggacgagtgggaagagggggcagactttgtgaaaagatggggaaattttggggggtagatggggggaagagagaggtgagcaggagtggggagaaggctttgagaaaagatggtggggaaatgtttttgggtagatggagaagggaaagagtggcaaggaggagcaggaggaaagacaatgaggaaaacagtttttgggtagataaagggggaaaagagggtggtgagcagcaggagtagggaaaaggctttgggaaaagacggggggaaaatgtttttgcttagatggaggaggaaaagggcatgatgacagcaggagggggaaaaaagagggtggccagggagaagggggaaaatacggtgggaaaaaacgggagaaagtgtttgggtagatggttggggaaaagcgtggtgagcgggagaatagagaaggctttgcgaaatgacgggggcgggggcggggagaaaacgaaatgatggtggggagaaaacggtgaaaacgtttgggggtagatggaggaagagaaagggtggtgagagggagagggcgaaatgcggtcgggaaaagaaggtggggaaatggtgggggacaaaagttttgggtagatttttaaaaataagattatttgtattttcacttttgagtagtttgagttctttagatattttgtgtattaacctcttgcctgatgcatagctgcaaagactttcttccattctcgggttctgtcttcattatactgattgcttcctctgctttggaaaaggttttaagtttaatgtaattacatctttgcttttgttgcttgtgcttttgatgtctatttgaaaattccttgtcctaaccaatttcatgaagcatttatcctatgttttcttctctggtagtttcatagtttcaggttctgtatttaaatctttattttgagtagatttttgtatatggtaaggtaatggcctagatgtattcttgtacatgtgggtgttgggttttcctagtacagtttattgaagagattgtccttcccgaaggtgtgttcttggggcctttgttaaaaatgaattgaccgtaaacgcgtgaatttatttatgatttctctattctgtttcacttgtctatgtctgtctgtctcattcgttcatctctcttgtctctcccccgccccttttattgagagtaccatactgttttgatagtaccatccttactataaatttgtagtatattttgaaatcaggtagtgtgatgcctccagcttttctttttattccacattcttttgtctatctgaggtattttgaacttccatgtgaattttgagattctttttctatttcaatgaagaatgtcttgtaattgaacatagattgcattgattctgtagatcacattgggtgatacacatattttaacattcttctagtgcatagagatgggatatctttccatttacttgtgtctgctttagtatctttcatctatgttttatgaagttttcattttgggatctcttgcctttttggttaagtttattcctagatatcatttttttggtaatgaaatagctttctcgatttctttcttagatatttcactattggtgcatgggtgtagtattcatttttatattttgatactgtatcttggaacttgactaatttattgtttctagtaggttttttgtggaatctttagggttctctctatatatgttcatgtcacctggaaacagacaatttgactccttttttccaatttggatgccttttattgcattctcctaattgctctagctaggacttccagtattatgatgaacaaaagtggtgtaaaagtagccacacttgttccagatcttagaggagaagagcttttaacttttccttcttgattatgttagctgtgggtttgtcatatatggcctttattgcactgagatatgtgtcttctgtactcatgttgttgagtttttatcatgaaggaatgttgacttttatttttttcagcgtctactgaaatgattatatggtttttgttgttgatttgctgaatgtgatgttgcatatttatttgtgtttattgaatcatcctcatattcctgggttgaatgaaatccacttgatcatggcagatgatctttttattgcattgtcaaatgcaattttcaagtattttgctgaggatttcttacacctctgttcatcagggatatttgcctgtggtttcctttttgtgttgtgttctggtctggtttttgtaccagggtcatgctgtcctcatagaacaagttttgaagcctttcttcctcttcattttatggggaatattttgagtaaaatagatattagctattttaaaaatgtttggtaattcagcaggaaaaccatgattcttgtgtttttctttgccaggagactttttatgactgctttaattgcattcctcattattggtctgttcaggttttttatttttattttttatcattctatcttgggaattcgttatgtgtctagaaatgtattcacttccagatttttcaatttctttgtgatgtttttagtaatcttttaatgcttcgtatttctgggttaccagttgtaatgccttctttatgactttgttttctttttatctaagttcatctagttaaaactcgtcaattttgattttttttaaaacaccccagcttttgtttcattgactttttgtattttttgtttctatttttaaaatttcttctctaatctttatggtattttttctgcgaattctagcatttgattgttcttgtttttctcattacaggaggtgtactgtcaggctatttgagatcttcctacttttctgatgcaggcatttatagctatacacttttcctcttagaattgcctttggtgcatcccacaggatttatgttgtgtttctattcttacttgtttcaataaatatttaatttcccttgtatttttttcatttcttttattggttgttcatgagcgtgtattttaatttccatgtatttgtacagtttttaaagttctatctgttactgatttctaatactattcgactgtggtcagaaaagatacttgatatgaattcagtttttaaaaatgtgttgggtgaccgaggcgggatcacgaggtcaggagatcgagaccatcctggctaacacggtgaaactccgtctctactaaaaatacaaaaaattagccgggtgtggtggccggctcctccggaggctgaagcaggagaatggcgtcaacccgggaggcggagcttgcagtgagccgagatagtgccactgcactccagcctgggagacagagactccacctcaaaaaaaaaaaaaagtgttgtgacttgttttttggcctaacacagtctgtcctgtagaataatcgatgtgccactcagtagaatgagcattgtgcagttgcagagtgaaaagctgtgtaaatgtctgttaggtccattctgtatagagtacagtttaactgatgatgttttgttgtctggatgatctgtccgttcgcgatagtggggtgttgattacggtggagtgttgaggttactctattattgtattgcagtccctctgtcctttaaagcctgttaatatttgcatctatatttaggtgcttcagtgttggttgcatatgcacttaacggctgtttacttgtttctcattatataattatctttattttttctttttttgagttaaaggctattttatctaagtatagctactcctgctttttttgtttccgtttgtatggaatatctcttatcatcccttgactttgtctgtgtatgtctttataggtgaactgagttccttgtaggcaggacataattgggtcttttaatccattcagccactctgtcttaatttaatttacattcaggattattacagataaaaacatactactgccattttttacttttttgattgttttgctttttcttttgttctttctcccttcctcttttctttctgatctctttttatttcttctctttcctccttgcctttcttcctgtctttatttgtagtgaagtaattttttctggtagtgttttaattccttggtttttatgtttagagtgtctgttgatttttgttttctggttaccatgaggctaaacaacataacaagttactttaaaccgaagaaaacttaactttgattggtctcagctactcaggaggctcaggtgggaggaccgcttgagcctgggaggccgaggttgcagtgagctgaaattgcaccactgcactctccagcctgggtgacagagtgagaccatgtctcacaaaataaataaataaataaaaatgcaatagctttataatgaattctgattgtaaatttggagatgatatattaaggtataaagaggaaagtgaaaatcataatctcattacccaaggataactacttctaatgttttggtacatacgcttcctaattcataatcccctctcttttacacacacacaaatgtacacgtaaaatagactttacacacataaaattttattgtaacattttgagaaacacggttttgtaattttttctttaaaaatattgcagataagttctgtgaataacatataataacatacatcttagttttcagattttgttttttgctcttttgggtggcaggttcgcttttggctaaaatgaatcgtctcagtatctttgattttccttctctcctctaagctgttgcttttggaaggggcgcctggatctccctcctatttacttgggggcaaacacatagtatcaaggggttttgaagacacgttgcctgtgccagatagcaacactggctgtagttctgaaaatattagcgtttttgtcctgtgattaatactaagatgtaaatgaagtggtttagatcactgtagcaaatgacctagatataactgtgtgtgtgtgttttagatcattgtagccaatgatttagatacaactctgtgagtaccttttaattaagggctcaagatttctacacagtatgttcattgtctgctttatttgtagaagtgtaaaagctgatacttgggtgatgtaagaaaatggataggttttactatcacaaggaaaaggtaatatccatacacttttgccaaggaggcatgggttacttaaattggcttctggatattggagtttgggtatgatagccttacgttgaattttttggttactgcttgataatatttatttcagtaattgtgtttagtaattgattgtgtgtgttaatgaacagtcctgtcctaaaagcaaaaatgaagtggttcaagggagcatgaattgttaacatctcctttaaacaaataggctaggttaaaatttttttacagagctttacagtattacatgtgagtttattacactattacatgtcaataaaaatggcagcagaagctctcttaactgacttgccagatggattagatctctccattcactcaataaaatgtccattttattgagtcttaatccattcagaatccatttagaaatactatcttatttaacctgtaccctgtttcaactagcaactggattataagagatgtgtattaaatattttagaagacagattcttttaaataaataaaaattatcacacaggctgtcttaaacttttaaaaaagagatctgattttagatttggttaaaatactagcctacattagtattctttctaggaaataaatattcacataaattgtttttccagaaattggccttgaatacagatttcagatcgttgaaaacggaaccatttgaaatctgcatttcctttccttttcctaatttatttcagtcgctcaataggattttctcatggaattaacttttccctctcagcgtagttacataagcttgctgttgtaatcatgaaaaataattacccatttcagcacttactaacgtggaccttacttgaagggtctctggttttaaagtcagagcacatggctagaggcagatgaagagtacttcatcattcatagccactgagtctctataatttttaaatgcctttggaaagctagatctcatactcaaaagcatgcttttgtgttacaaatcttttagtgaactacttactcaggtcataatgcttttaaagccctgtttttctttcctcagaataaactgaattacatgttaccaataacaatgccacatcatttcaaaggaaactgaattaagtaatccaagtccgggttgctgaaaactagatgacacagggtaggcactgttttggttaccgtgcaaaggatctctattagtcagcttgggctgccataataaaataccatagaactgggtggcttaattttctcacggttctggaggctagaagctgtagatcagggtgctgctgcttcggttcctgatgagggctttcttcctggcttataggttggctggcatcttgtcctcacatggcaaaggggagagtactgtagtctcaccttgtcttaaaatgacaccagttctatcagattagagtcccaccccatgacctcatttaactgttagtacctcctcacaggccctgtctccaaatttagctatattagggattaaagattcaacatataaattttgagagggcacaaacattcagtccgtaaaagaaactagttgtttaattaacaaggattgttgagccctgatatcttgttatacctgcctgtgtccttcccccattcccctccactctcatttcctcaaaaacactcagataaggatttttttcagatactgttattgttacttatcaaactacgtagtaacattatgaattataaatgttattagccattgagaaagtagctgtgcactgactgaccccaattgactgggagggctagatggtgccttctctgtggtggaagataggttggagaaatgtggttggtagcaaatgctgtctgatttgaacagctttgaagaaggctggttctagttgatttcagttctctccagatgccatttgaatctaaaccaattttctagttcttatcattacagaattgtcttctggaacaattatttctttttgttacttggtagcaatatggatgtagttttctgaatcattaaggcattttaactcatcttccattctcttattttttaagtcctttaggttgtttgagggacattcatcaaggaaaccggagaaacttaaaatgctcttccgcttctttggaacagtcacagagaaaagtgaactcctttcattcttgcagtaatttttcttgctgatgggaacagttcaagtcaagtgacatgtgaggaacattttgtgtttaacgtaaaccttcctgtcccaactacattgaaacagtaatgatgcgacaaggtaacttcggttttatgcttgtgttgtgtataagcataaatgtgtgctataaatgtaggggggcggggtttacatactctgaaatcggacacatattctatacatcaaaacattttcatgaataaaaaccagagaaactatattgaccaggaaataaattttggatgctctttatttaaagaagcattcactagtttatttgtataagtcaactaacgcattgcttttctacccattcctctcttttgtgcccccctaagccctttgtggagttctcataaaactgttttgtactgagttttatatccatcttcctctattgaaccttaacattcttgcttccccaaaacctgaaagcagctgaggcagtaatagtaaatgtccaacaaatactggtaatgaccaactgataatagattggtattgccactcttatctcagaagctgaatgaccgtggtcaagtttcttgacacctctaagcttcagttttatcacctatgaaataatataataatggttattatcttacagggtagttatagatattaaacaaggagatacatgcttaataaatgtaagctattatcaatgggtagcctttcctacaagtggatgtaaaccagaacaccttaaaagtttctttgtgctaagtaggtaatgtcaacctggtcaagtgaaatggctttttttcagttctgggttgtaggattgtcttaaaacatgtctttgaacaattttaaggtcatttttctcatatccttcttttactcttgcatgacagtgtacttggcatcttcccccttgaatgtattgctattggacattgttaaatttttagaatgaaatcaattatcaggattttaatatttaagggaacattatatgcttctctgatacggaattatttatctcatagcttattgaatttcagttttgtgccctgtactgaatgaaatattaaaatgcagaatcatttggacctatgagacacaaaatcaaattagaatttgtaatgacttgttaaaaagatgactacgtaaggccaggcgtggtggatcacgaggtcaggagttccagaccagcttggtcaagatggtgaaaccctgtctctactaaaaaatacaaaaattagccaggcgtggtggcaggagcctgtaatcccagctactcgggaggctgaggcacaagaatcacttgaacccaggaagtggaggttgcagtgagctgagattgtgccactgcactctagcctgggtgacagagcaagattatgtctaaaaaaaaaaaatgactacttttttttggctattctaggtctaagtagaattattactgttggtcttttttgttttgtttttacagtactttgagttgccgttttaagtagaattgttataactaagtagtacagagtttacttttttgtcctgggagtcaaatcatgtatgtcttctctaaaaactaacttggctttctacattttaggatttcagatactttgaggaaaaagctaaaagtttgttttttaaactagaaatgtatatgccattataagtatttggaatttgaagaaataaattataactagacattttattttctgacttttttactgtacatgttaattaagttctttgtagaaatacagtacaacattgctcttggtctgcagtatgtaaagctaacggtttaaagaggaaatcctaaagagaataaaagaggttgcagtataatgagtcgttgtgtagaagttctggagcctactcaatagactggagaagcttatttaaggtaccatatttcatcgaatctaagatgtcatagattatttttaaaaagtgctattacattatatacctctaagaagggaaaaacactcaggacagggagtttagtaggagacctaacccacaaggctggtacacctagggataaatgagaaattaacttgaccatccagaaaagggaccataaagaagcatgcaagtctcaaccttgacactaaatagagaaagaaaaaaacatttctctgagaatttgaaccacaagccctaagctttgggtgtgcagccttaccaccagtgtggtccacaaaggcctgccacaaaggattaattcagatggtgttgggctgatagtgttcccagatgacagcagaagcagatgcacaccttctctgggaaaattctcctctagtctagacctatggtaagatacctccattataaaagatgtattccagtttcagaaatgtagtatgtggaaaaacccgccttttagaattgataaaatagaattccatcaggaccaacttttcagtgttgttaaacgtgtattttatatttgatgaggatcttgagactgaaatgttttaaaaagccttctgaattaaattactttttatatagttttagataaagtatcttatagatcagatttttgaaaatttatgacctgtatgtagtatatattgtgattttattatgggaagtatttgattaatcagagtatcctattctgagatgaaagttgccttgttatgaaaaagaaagctaacagacatgctctcaaggcattttttgttaatctgagaaaccatgttcttctgccttttcttgctttgccagcagtgtttacgaatttctcttagcatctcttagtatatatgaaggacatttggtgttcttacttctctgctaagttaccgaatgacaagagagatgttttctattatattcatggaattgcatctctagtgttagagttgtttgaccacttactcgtgagttttaaatatgttatccgtttatcttaaagttagatatctaaagaatgtaagacctatgttaacaaaaaattttgttttcttctgcaactgctccgtatggtttttgagtggttcctgcttttgactgagaacaaggaaatgtggaattgtgcataggaatgaaatgatggccaggctttcactgggttatacactgtcatcagtaatagttcctgacatctctctctttccttaagagcttttttctattcaagaaaacagaaatggcatagcctttttagtttgctctttgatttgagtcagacaaattacttctggccagctgatatatttgtttcttttgctactagctttaaaaaataaataaatctgactagaaaaggatctcatcctcttaaaattattgactacattaatactactccattttgatcctcccaaatgtattgcttcttgaaaaatatgtcatctttattctgtaaactcttagaaccagtaatttcttctctggctaagactgctactaacaagtagagtgattgcccactatctaagcctgaaacttagctttactaacttcagaggatgtgcaaatgattttctttttaaagctgtggcatttcactttactacaaagtacataaatgtgtctttattcaccagtctttgaatgtagggttaagtcctttctttgtaaaggagtctacaaatttgaattcagttttgtctttactgcataagctgtaccagttatacatcctttttttcaatggttttgtttttaaaagtgtattcagcttcaaaactttaccaaaaagtaccagcactcaaatcctactgttgtgctgttatttgtatagtttcgtttagtgaagtcttactgttttataggagtttctactgtaaggataatattttcaatcaatattctgttattttccaatgctaggctttgtatttcctggttagttttatagtcaatgttagacctattcttttatcgagtgtgtgtgcgcgcgtgtgcacgtgtgtgtgtataatgttttcaaaattgaaacttattttgggtatgtttttcttttattgcttctgtagaacctactgggttggtgacatttacaagacagagtcttgaggattttccagaacgggaaaggtaacaataataataaaaataatcctagacccctagaattagaaggactcttgcactatgagaggattctattttagagcacctggaaagatggttttccaacctctatcctagtgccagggaatttcttctcagaagtgatccatcgatagctttcatttttgaaaaggttatgccttttaaatcaaagtctgtaaccctttgatttctaccattttgtcttggttttgtcttctgaaagaaagcggtgtttaaaattgaggagtgttgtatgtgaagacactaataaaaggaacgccaatatataaacgtttctccttaccctttttttggttagtgtttgaactttatggcttttctttctggaggacaagattgagaaaagtctttttattatttacattttagtaaatagtaaccgtctagagtttgagtggcaagaattttgaagtttggctgcccttgtgtactactggtagattttctgcaagttgctatttactgtttgtttcttatttatcagaaaataattgaggagatagcagccaatctgagctaattcagatttgtaaggtccttagtgtcctgaaatagttaacatattttttaatctaaagcaagtcccccaatgcacttaaagaagtgtggattaactttttaaatatgtttgaggacatggtgaagcatactaaacacatatttaaccaatgcttcccattttcactttctaataattttatgatagtttgtaattgttttgtttggaattagtgatgaatggaaatcacttaaaaaaaaaagttgagaagtcatatctgcttaggtggctttcctgcggtgttttcatccatcaaagatgtttatttgtgaagtgaaagataaagaaatttactccagaagactgagtgtatggtttaggtgattattaatagagggaagtagataaaaggttaagaaacctgaagagagaaaaaaaatgagccagaaaaagatgagagcatgtacagcattttggcatcatgccatgtcagatctgaaaggaaccccagccgcctactaaaactctcgatagctctgtaatacctgcaacagttggagactggatagcttcagtgacggcaaatccgctgttgcacatcagtttgttccattggtggctgcttgtgttatcatctcatgctttcattcactaaaaatgttttctacattcattctccactattcctggttcttccttctagagctatgtaaataaatctgaatttctagttttctttaagatttgaccttccttcatgtatcttaatggcttcttgacctactttcctctccaaaagtgcatacaagttcatactaaactgattcatttcttctatttcacatgtaatatggagtctaaaccctttatctctgctcttaacagagtagattggttgcagtttcttgggtgcaggaatgaaaaaatgagtacatttgcctcagcctcccatatagctgggactgtataggtgcatgccactacacctggttaatttttgtattttttggtagagacggtgtatcaccctgttggccaggtttgtcttgaactccagacctcactgcctgccttggcctcccaaattactgggattacaggcataagtcgctgcgtctggcttgggggagttactgttgaagtattgtctttgtatcccaaagcaggcccttctgaaactgatgatgttgatgaaaaactccttctactgaagtctttgcaatgtataatcttttcacttccattttcctacatactgtttctattggttccttgtattccacagactgtgttttagtatttataagtatagtgttccttttctatgtggaaaagggaaaatgtattggcctttttttaacatataaatgaacttcacaagcaacaatttttcaaatcagttttccctgttgtgaatctcgaagtgggtacatgatgcactttcccatttaaggtaaagtacacatttatcccttatctcagaacagtcagaagtcaagttcttattgtatggttagtaatgcaaatattgataaggtcatgtgaatacttagtatttagaagaattctgaaatagcacttgttactctgtaagttttatgcatttattactttttttgaattttttataatgttcccaaacttgactgccttacttctatctcttctggcctcaagtacaacaagatgtattttctttagatttagcatataatataaattcaattgtttattttagattttgaaagaacaaagaggaactacagaatcattgcttacattgacaccggccctgttgtcccaatggatgggttttttttggatgaacgtcaaaattgaccctgctgttaaagcttgaaacttggatctgttgtatctgagttctctcctcaaaaaaagaccttcaggaagtatcagataactgaaacataccagatcacagcaccacatgcctcctgcccctccctaatttctgttctcttatacattgttaaatttttttcctgcccctattagtcaagcccatggatttgagactgagctcccagctcctgggccgcagcaccaggttaaagctttcttccttggcagtacttgtcacctcagtgactggctttttctccgatgagcaggaggacctggacgaaacccctagtgtttgggtaataacatgaacgaccatcttaactgttattctttattgaaattttactttttaactactggcctcttgttcattatctcccattcttttgacttcatatctcttttttcattgactttacagtcaaggaacttgatgctccctaaatccaaatattacggttaaaagaagagagaggaaatgtgtgcagagaaagtgtattttacaaatgaattaaaggtggattctgagttacaggtttatagatttacctagagttttgagttcaggtgagttttcacaatatgcagtaagtggaaaagaatcccaaaataattgtgacatgaaaaagctaggtgttgaaaaccaaaaagatttcactttggtatggcacttttaattcaagaatactagccaccaaatgagtttttctgactgtaatcattgctctttaaaaattgagatgtatttataacttttgtttgacttttagtacagcttctgaatttagttatcaatagataggacaaaatagatgagcatctgcttcccttccccctaaacaatgtattcttaccgaaatgtaatatatttttatttatacttgaagacagtgtttttcaatcttttccatgttagtagctcagatctttaaggacagaggatgtgtactgggggcagtttgtggtcttaatcctaagtggcactctgatattttagattatttctttcatatttgtgagtaaaacttctgctccagtaggatgagcctgtttaccttgtgactgcctaacagatctgttgctttatatgccagtttttagaagcaggcagattacgttacttggattaaaatgtttttgacactaaaggtagtatcttaaatttttacatatgagttactttaagtacaactttgcttaaattatggggatcgagtttccataactttcaccatagtgaaaatggaaagcagggaacattccacagcaaatcctgaacttatttacagagttaattgagcaaagcaggcattcacacttgtgtgtgtgtgtcagtgacagatgagcatggtacttgaagcataattgtgctgcttcagattccaatatccagtaattttatcatgtagctagagtaactaatattaagtccccaagcctacttgggtctactgtatttgtattttaaaagaatgtttttaagctaccaaatagacatgttatatatttcttctgaattagaaaacgttatttggattaatagagttaatagaatcatattttatgtttattatgtcttttttttttttttcctgagatggagtttcactctcgtcacccaggctggagtgcagcgacgcgatctcagctcactgcaacctccgtctcctgggttcaagtgattctcctgcctcagcctcccgagtaggtgggattacaggcccccgccaccacgcctggctgatttcttgtattttagtagatatgaggtttcaccatgttggcccaggctggtctcgaactcctgaactcaggtgatccgccctcctcagcctcccaaactgctgggtttacaggtgtgagccactgcacctggcctattatgtcttaaaagtgcttgcatcgtcacctagattattttttatctttcaatgtgagtttttattggtttatatgttgtttgttttctttttaggaagccatcattctttagagggcaatgaccaaacagtaccagcagaaattgaagtaccagcagaaggctaagaaggttaggagaaaaagacattttgtattttactgtttttttcttttttttttttttagacgaagtcttgctctgtcaccaggctagagtgcagtggcacgatctcggctcactgcaacctctgactccctggttcaagtgattctcctgcctcagcctcctaagtagctgggattataggcacagaccaccacatccagctattttttgtatttttggtagagaccagggtttcaccatgttggccaggatggtctcaatcttttgacctcctgatccacccacctcggcctcccaacatgctgggattacagatgtgggagcttggccacctcctcttgggagaaatgcactgattctggttgccacgtggatttattttgggagtgatattcatctaacttcatggaaataatactagatagagaattcatccgctaactttctatctgatgagagttttgggcaaatcgaataccaagttaccaagttttgtttttttctctgatgcaaaaaaacaatttgccagccagtgaaaaactctcacagctctggatgtgagtttaggatactggatttctaccattcaatttcttactacttttcttgcacagggatcatggcacaagctgcagtttccaccctgcccattgaagatgaggagtccatggcagatgaggagtccgttgaagatgagtccgcagagaacaggatggtggtgacattgctcatatcagctcttgagtccatggtgagaccttccgttctaacattctgtaattgggtagtactgggtggtagataaggttgatttgtttttgtagaatttataattttatgatttatagttctaatgagtagatctttttcttgaatagtagttatggtcaaacacttctgaccaaatgtgccatgttgtccagcctggtctcaaaatttggggctcaagagacctgcccaccttggcctcccaaaatactgggattacaggtgtaagcccctgaatctggccagatatttttctttttatggctgaataatactctgtgtatgtatatattacattttctttatccattcacctactgatgggcattagggttggttctaccttttggccactgtgaataatgctgctgttaaacgggtgtacaaatacctgtctgagtccctgctctcagttattttgggtatatacacttaaagggtgttggtggatcatataattctgtgcttaatatttttaaggagctgctaaaccattttccacagtgggctgtaccattttacattccaaaaggcaatgcatacagcttccaatttctctatagcattgctgacagttaatattttctgtttatgtactgtatttttatagtgtttgaaattaatctgagggtttttgctgataccaaaatattaggaaaggttttccaaaaataatactgcttattataaagaattttatgtgttacttgatgccctgtgatccattttctcagtaagaagaggaacttctcggctgggcgcagcagctcatgcctataatcccagcactttgggaggccgaggcaggtggatcacaaggtcaggagttcaagaccagcctggccaacatagtgaaacccagtctctactaaacaaacaaaaattagctgggtgtggtggcgggcacctctaatcccagctactcggaaggctgaggcagggaattggttgaacctgggaggcggaggttgcagtgaccgagattgtgccactgcacccagcctgtgtgatagagtgagattccatctcaaaaaaaaaaaaaaaaaaaaggaaagaagaggaacttctctccattcaacctcattccactgcaccaactcttctgtgtcgggttgtgcaggggagaaagggagcttggcacctctttgctgtgttgagttgtggtagcccatcactgggttgtaaagtgcattgcctcctccccccccccctttttttttgagacagagtctcactctgtcacccaggctcaggtgcagtgctgagatctctgctcactgcaacctcagcctcctgggttcaagcgattctcctgcctcagcctcccaagaagctgggactataggcacgtgccaccacacctggctaattttttttatttttagtagagacggtatcaccatgttggccaggctggtgttgaactcctgacctcaagtgatccacccaccttggcctccgaaagtgctggggttacaggcatgagacactgcgcccatccacctcctcttttacttgggagaaatgcgcagattctgggtgccatgtgcatttgggagtgatactgatctaacttatggaaataatactagatagaaagttagtggatggattctctatctgatgagagttttgggcaaaacgaattcctagtttctgagtcttatttttcccctgattcaagaaaactgtgaattatccagccggtgaaaaactctcacagctctggatgtgagtttaggacactggatttctaccactcactttcttactacttttcttgtgcaaggatcatggcacaagttgcagtttccaccctgcccattgaagatgaggagtttgttgaagatgaggagtccttggagagcaggatggtggtgacattcctaatgtcagctctcgagtccacggtcagaccttctgttctcacattctgtagtttggtaggactgggcagtagataaggttgatttatttttgtagaacttacaattttatgattttcagttgtaatgagtagacctttttcgtgaatagtagttatggttaaacacctctaaccaaatgtgcatgtggagtttctacactgattttcagacaatctggatcccaactgggtatcccacaattccatcctgacactccctggagttagtgcagaccccgcaggatggggtctcagtcccaggagtctaccctcactccacatgccaattgcaagtcttgggttgttacatgtagttttgaccgaccagttagaaaacagggtttcatgaccccattgctgggtggaatcatttgctcggacagcttgcagaactcagaaaaacaggttgtttttttttttttctgagatacagggtctcagtctattgccagactggaatgcagtggtgtgatcaaagctcactgtagcatgggactcctgggctcaagtgatcctcccacctcagcctcccaaatagctgagactacaggcccgcaccagcatatctggctaagtttttttattttttgtagagaaggggtcttgttatgttgcccaggctggtctcaaatttctgggctcacatgatcctcccacctcaacttcacaaaatgctgggattatgggtgtgagccactgcatctcaccaatttactttcttttactggttcattttaaaggctatatctcagaaacagccggtgaaagagatgtacatgctgggcacagtggctcatgcctgtaatttcagctctttgggagactgaggcgggagcatcgcttaagtgctcaggagattaagaccagcctgggtaacacggtgaaaacgcatctctacaaaaaggtttttctaaaaattagccaggtgcagtgatctatagttctggctactcagtgcctataattctagttactcaggaggctgaggtgagaggatgagagatggggcttgagctagggaggcataggtcgcagtgagccacgattgtgccacggcactctaggctgggggacagagccagaccctgtttcaaaaaaaaaaaaaaaaaaaccacagggcaaggtgtgtcgggaggtcgggaggggtgcagaacttccatgctctctattgcgcgtgttaccttcctgctatctcccttgtgttcagcaaccccggcattctccaaatctggttgttgaggtcatttatgaaggcttctttaagcaggcatgatagatgaaatcattgactattggtgattaagtcagtcttcggccactatttcttcctggagcccagtgggtgaggctgacagttccaagcctctaatcacatggtttgttcttctggcaaccagccctttttcttaagcggtctaggagctttcagtcacccagtcatctcagtaacatcaccaaatgcattcttactgtggtgatcccaaaggtcttagaggctcttgtgttagaaacctgggactaagaccaaatattcaaacaaaagatggggtcctatcacctttatcaccaaggcctttataagaacttgagaagctctgtgccaggacgaggggcagaaaccaaatgtgtattttttttctttttcttttgaacacagagtctctgtttcacccaatctggagtgcaatgatgcagtcgtagctaactgcagcctcaaccacctgggctcaagcaattctcccacctcagccttccaagcatctgggactacaggtgcacaccatccatgcccagctgatttttgtatttttttgtagagatgggatcttgttatattgccgaggctggtcttgaactctggggctaaagcaatcctttcaccacagcctctcaagtagctgaaactacagatgcataccaccatgcccagctaattttctcttatttctttttgttgtttaattgagggggggggggtctcactgtgtttcccaggctggtcccgaacttctggcctcaagcatttctcctgctttgacctcctaaactgttgggattatggttgtgagccccggcctctgtgtccagcaatcacaagaggtctttataagtgaaagagggaggtaagagagtcagaattgaaggagatttgatggtggaagcacaggtcacagagggagatttgaatatgctttgcttctggctttgaagatgcatttaggggccatgaggcaaagaataggggtggcttttggaactgggaaaggcaagggaacaccttctctctggaacctccagaagggatgcagtcctgctgacaccttgactttagccttaatagacctattttggacttctggcccccagacctgttaggtagtagatttgtggtgtattaagccactcaacgtagggtagtttgtaacagcagcaagaagaaatgaacatgaagccaggggtagtggcccacacctataattccagctatttaggaggctgaggcaggatggttgctctggcccaggagttcaagataagcctgggcaacaaagtgataccctgtctacatgggaaaaaaaaattagcgggtgtagtggcatgcacttgtagtcttagctactagaggcgctgaggcaggacgatttcttgacctaggagttccaggtctcagtgtgttgtgatcgtgccatggtgccccagcctgagtgacacagcgagattatatcttaaaaaaaaagtaaaaagaaatgagtgagcatggcaggaatggggacacatagcaatattaaatagagtggtcagggttggcctcctaagtgaaaattgagcaaagacttgaaggaggggaaggagctggccaaggtactgagggaagagcattataggcagaaacaacagaataaagatgctaagagggaactccgtggtgtgtctgaagctcaggaaagaggattgtcgagcagagagggggagagaaggtaggggaggaggccagggagttgtgggactcagatcagtacagattgtgcaagccctgggaggctattgctggggctttggcttttatgctgtctgagatgggagatgcggaagggttctgagcagagaggtgacacgaactgtctattgatttaaaagcatcccatggtggctgagttgagaaagattgtgggaagatttgggtagaagcacggaggccaagctgtggcaacatccaggtaggagatgatagtggttctgaccagggtcctggcaatggtgagagatggttgattcttgttgagatactaagtaattaaaaaaaaaaaacactactgcttttcctgattatatgaagtatgggatgctagattaaagacatcttaagtcgggccaggtgcagtggcttacgcctgtggcgtcagcactttgggagcactttgggaggcacagatggcacagatgggagaattgtttgagtccaggagtctgagaccaccctgggcaacatagcaagacctcctgtctatgcaaataaaaattaataaaatataattatcatgggatagtggtattttcctgtagaaccagttactctggttgtcgagatgggcagatctcgagggtgggagtttgaggccagcttgggcaacatagcaaggctcctctttctacaaaaaaaaaaaaaatcatctgggtgttgtggtcccaatgagggacagcattcctgagactttttaagtactttgtgtgatggtctaataatcatagccttaaaactttctggctgggcatggtggctcacacctgtaattccagcacttcaagaggccgaggcgggtagatcatctgaggtgaggagttcgagaccagcctggccaatatgtgaaaccctgtctctactaaaaatacaaaaattagccaggcatggttgcagcacctgtaatcccagctactcgggaggccaagacaggagaattgcttgaatccgggaggcagaggttgcagtgagctgagatgggccactgcactccagcttgggcagcagagtgagacttggtctcaaagaaaagttattgtgatatgctgtacacattcacaaattcagtgtctcccagaagtgtgagattcttttttttttttttttttttttgagacagaatttcactcttgttgcccaggctggagtgcaatggtgtgatcttggctaactgcaacctccacttcatgggttcaagcaattctcctgcatcagcccaagtagctcctgcctcccaagtagctgggattacaggcatgtgccaccatgctcagctaattttttatttttagtagagttggggtttctccacgttggtcaggctggtctcgaactcccgacctcaggtgatccacccgcctcggcctcttgaagtgctgggattacaggtgtgagccaccatgcccagccagaaagttttaaggctatgattattagaccatcacacacacacaaagtacttaaaaagtctcaggaatgctgtccctcattggcctggtatgacaaagataagaagtcggtcgtgaaaatttctgaacgtggtttaggacaaggaaccccagtaagattcagagacaacctagaaaattgaaagaaaattttactactgaaatcatccttctataaaaaataatagaagatgtcaaatatgaaaataaaactgtcctctgggccctcaattttctgtgtcatgggagaaggcagacagctactcagcagttatatcccataagaatggataatactaaaacaactgacagcatcaagtattggttagaaagtggaactgattctctcattttcattgtagtttaagatggcataaccacttaggaaaatgtctccccatttcatacaatgccaaatatatacttattttataacccagaaaatccactcttatgtacttaaactcaagaaaagtgaaaatattattacagaaaaaaatatgtatatctgatttgttcgtagcaggtttattcatgatagcctcaaatcagaaactgcttttgtgtctatcaatagtggaatggattaaaaacaaaacaagcaaaggcctcaaacctgtggtatagtcataaagttgaatattagaaaataatgaataatcaataggagcaaaatgatgtgtcacaagcatgtttagtgagtgaacataaaaattatataatttatagtttcacttacataaatggtgaaaacagacaaaactaaccttttgtggaaagaatcaaaaccgtggaagcctctgtgttcaaatactgactggaaatgggcaggagaaaacatgtttctgccagatcttctatatgcctgatgtgcattcactcgatgtattttgcgtatactatttttgcaaataaaactgagataaaggcaaaataactcaagagaagatagatagaaataggtagagttgggatagaagccttcgaagctacccccgtaccttgcccacctggcacaggccgaggaagtcctgggacaatgctgtgagcgacctgagggccgtccaggggagccccgccagcccatgctggcgcctgagctgcccgccgccatctgaatatgttgcaaagacagtgctggcctggcaaccggtgacgccccaccccgacccccacttctacccaagtagtggctacgctagagacagattcctgggcggcagcggttaagtctggcagttggccaggtggccaaaggacgggaactggccgttcaccccatcccagttccacagagaactcaaccactatggcccctgagcggaccttcaggcctggtgggctgtgctctgtgcctgcaaacctgacgccatccaggggagctccgccttcccgcgccagcgcctcggctgctgcagaaaactgcaaaactgcaagttgcacacgggcagagatgacggagcaacccccgaccctccgcgccactcaccctacctgcacacctgccgcgcggaccctggggcgggtgcctgggtgcccaagtcaggcagtccgcacagcagtggcaccagggtgaaaacctgctgctcggtaccatcccggttaccacgaagagccagtcccggcggcccctgcgttcttggaggaggccaagtcagagcaacctctcaagtgggagggcgatgcacttgaccctgaggacatcaggtaccaggcccgccagctcacgcctgcatcggagccgcagctgcagtctagacgtggtgcaccggcagcaagtgactggacactccagaccaggcccgccccgcagtagcgtggatcctgaggccagacccccaggcggcaaaatcaggcaaccggccccgccagcagccgctgtttcatccgtgtggacacagagtgcccagcgccagggcccaggatccagaaagatgtccaagaggagcggaccttgaggccaggtgggctgtgcgctctgcggccctgaggccatccaaaggaagctccgccatcctgcgccagtgccagatctgcagctgcaaaccgcgcgtgtggcactggcagcagtgagggcgggtgggggaaggagcagtccctgactctgcctccatccctctccagctacctgacactagccacacagacttcagggtcagagcctcagcgttcagccaatccgcgaagccactcaggtggccgcggagtgcccttgccagcaccctatctcccttctgaggaggagcggggcgggctgcaaggccagacaggccctccttctcaggccgggctggctgcgcgcctgcgatcctggggctgcccgggcgatcccaggagaaccggcgagcccatcggcgcacgcccagagctgcagccccacctgctggcgcgcgccgccagggagcgtcttctgggagcccggcagcaactgccgtgcaggcgcgcgcccaacggctttgcgaggctcactcggtctgagaggtcggaggctgcgagtgtcgctgctgaaggctgtggtggaccgggctggatcgcggattgtgtagattatagatttgaaatagcggagttggggttggatcggggctttggggttggataggggatttggggctgggtcggccggggtcggggagggggttggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacaggtagcgggggctcagcccggggtgggagggggcccccaggcccggcttccccgcagaccctgggacggggccgtgcagggcgccgggcaccctcggagcggcggagccaaacggactctcagctgttttccatccctcataattccctggctggagcagttggagaatttgagtgatttaactcacaaagttaagcatatacagcgttgttatttttaacgtacacgtttaaaacatggtttatatacattataggaggtgcctaatgagagtacttgttcccctatcaaaaataaccgtgagttgtttcagtgggcgaaaagttctcagataagagagcttacttgaaaaatatttactatattatatatatatattttttcagatgaaaagtatgttttcattttatagggaattcattatattctttttttttttttgagtcggagtctcgcttctttgcccaggctggtgtccaatggcacaatcttggctcactgcaacctctgcctgcccggttcaagcaattttcctacctcagcctcccaagtagctgggattgcaggcaggtgccagcatgcctggctaatttttgtatatttagtttcaccacgttggccaggctggtctcgaactcctgacctcaagtcatctgcccgcctccgcctcccaaagcgctgggattataggtgtgagccaccgcgcctggcctatgttgtttattatatatcataagatatatatatatattactgatatgtatacatatataacacatataatatgttataaatatcagttatatatacacattagatgaaaagtacctcttcattttacagggaattctttcaaatcaaattatcaaacactctaaaagtgggcaaagtacctttttccagatctacaagttacttatatacataggaaaaaatccttcgcatttctggtataagaatttaaactaaaagaggaatgaaacagttttctatccacaatatttgtgaggatgttttatactgctgcttaaagttgctgattacttttcaaagtactcatttgaaaatggtaagtactacatttaaaaaatgtgtatgccctttacccaccaattccattatactaaaatacccttaggaaataaagatacatgcactttatttttcacagtacttattttaaagagaacccatagaatggatcctataaataaatttcagttgcatccataggatggaataatatgtgaccactgaaggtggcaatagatacagaagtacgttgatgtgcaaagatgtattttgttatagctagcaaggagaaaaaattagttaaattatacatacacaaacatactatggtcttgttttagcaaaaatatgtacaaaatataaaatttgtaatttctgagcatttgtattttaagtaaagtttttttcctttttcttatctgtgattgctgcagtgagtacaaaacttctagtaaaagtttattattaatggactaatccttgggaagagaggaatatgaatcttgtgctgatgaaaataatttctcactttctattttttatcattattgtgtgtgttgttatcttctttgagcttttagcctcttcagaagtaaaaagggaatgtttttatctgtttccagattttattatctatatattttattatgtacatatgttttgcttatatactcgttccatttatgcaaacataatcatttcattttaattgtattctttaaaaataaaacaacacatataaataattactattgcaaaaatattgctttataggagtttatttaaaaataatgaactccccaactgtatttatccattctttcattccatttatggatcaagcataacctgagtacctgctatgtagcagacatattctgtcatctctcaggacccgtccatccttaaacacttcatgtttacctgccccgcctgcacaagctgagagatttaaaataggaatattgggacttaatctccttgaaactttatctcccacctttcaaacaaaagcatttctgaagttagaaaatagtagaagataacctttaactgctctttcgaaagtttgtcagtcttaaatactaatattaatcattggaaagtcttatttgcatatattttctaagtataaatattgaatacaatgagccatatgtattcatttgaatcatgagtttcctttggcttcaagttgtttgaaaatcaaagaattaatttgtttaaaaaatgcattattgttatttcagtgctctttccccatagtacctttaagaactaaaatgtatttaagtttcagttacatgcctagaactgccctagacctgctgagtataccatattctacttaatgtaaggtctcatggattgcgtgatgccccgatattttatatatcaataagataatttttaaaatgctaccaattatagttataacaaatcatgaattataagtggcattccaatgtcagaggtgttaaaatgtgacctactcgttaagtcatcttgcaaagtaggtgtaattgtatcattctacctaattaaaatggttttgttaagtagtagtaatagtaataattataatatctggctgggtgcagtggctcacacctgtaatcccagaactttgggaggctgaggtgagaggattgcttgatgccaggagtttgagaccagcctgggcaacaaagtgagattcttactctacaaaaatttttaaataaatagctgggcatgctggtgctcatctgtagtcccagctactcaggaggctggggatggagatcatttgacccaggagttccaggtatagttacaccattgcactccagcctgggcaaaagagtgagactttgtctcaaaaaacaaaaatcttacaattattgagttgtcgtaggaactgttctgcatactttacatagcttctcatttaagcatcatgatggtgtcctatgagatagctactattgtcatctttattaatgaggaagttgaggtacagaaaggctaagcaatagttggtaagtgtcaaggcttaaagtaggactcaagccctagttgaaccgaatccaaagactgagctctttctactcaaataggctgctgttttcattaaggcagtgagcaataagagtaagtattgtactttcttcaaaaaatttatttgttttgaaggcagaggaaaaacatgctattcagtttttacattacatgaatgattgtatgttttgagatattgtactacagtttcttaaaaaatcctcttactctcatagaactgctctacacttggcctgtgccagtggccatgtgcaagtggtcactctcctggttaacagaaaatgccagattgatgtctgtgacaaagaaaacagaacgcctttgatacaggtatattagagccaactcttttagcatgacatggatttgatttacatatatagaattaaaataaattgatctcatttacatataactagttggtgaaacctgtggaatgtgtattttgaattcttggaatttacaatctgtttcttggtctaacacggacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggtataggtcaatcaactttctttccaaaatatttgttttaacattgacataggtaagggtcaattttttatatttggaagctcaaccattccctgaatgcaaatacaaattaagttattttgaaataacttaattgtctaagattttattttaaatattgatacttttaaagaagcattaaagggcacagctttataaaatgcactttggaaaatatttgtgaatttgttaaaggtaaaaccttttcaactttttttctacacaggcttattctttttttttttttttttcttaattagtgtaaaacaacaaaggaaagaaaatattccccggaaataggctttatcctaaaactcaaacaaaactaaagcaacttacaataaagggacatgttgctgctgctgctaattttctgaaaaactgatgtatcatctttcagtggcaaggcttaagagggaaaaatgggaggggagaaagagagcgatcagaaatatgcaggtcacttggatattagataatgagggaaaatgccaggaagaggtttttttttgtttttaagtttgttttatgtgttgagacaaggtgctgtttagctttgggtctaataatttttggtttgaaaaagaatgagttgcaacttgcctagagatgaattttaggaggactctgaggaaaccagattggcagtgaatatgtggtgacgaagtgagaaacacttcagcagaaggtggaacaaattattaactgacttattgctcatcctggcagaaacagccacttagataagaacctaaagcctcctctcaaatctagaatgtcttagtgggaaggtgggagataaggagcttgtaaatagcaaaatcaagtgggattttgagtttacttgtccctgttctacccatagccaggaaacttaactggagttttaataaatgacactatctcttactcttttctctttttggccacatctccaactgataaaggaattagccatgtgggtgagaggtgagactgaagtgattgtctgctgcactgattctcagaattgtgcattacagtgacctgaggacattttgttaaaaatctacaattgtaggctttcccctgaagattttgatgtaatagacctaataaggcctgaacgtgtttaaaaatgttttcttgaagctgggcacagtggtgtattcctgtagtcccagcttgagcctaagagtttgaatccagcttgagcaacatagtgagactcttgtctctaacaacaataatagccaaaaaaaaaaaaccacaaaaaaacaaaaaaccttcaaggttgggatacactcttgattaaaaaccccagaatagataagtgcaatatataaatttctgtatctcaaaaatgtaagaaatctctagaagagttggcatttgatagttgccacttccttcaaagttctccttttcaattatattagcctgacttatctgtctttctctacatctgtgactgggaagtgaaaggaaatatcattggcaatatctctcagcttacagaataacatgttttgcttcccaccatgaatcattcactaccattcagagagtattcagaaatttgcttatgagtaatctttcaacaggtagaggctgaccctttcatgatttcatgtccctttgtcaccacgcaggtgattatgtgtcaacaaatgttcattacaagtttggctttctcaattaagatagtagcaaatcctaaactattttttttagttgaagttttattatgaactatctcagtatgtttgttaagtttatagaactttagcatacccaaaatgtcagttttaaacactgaaatccatgaagttaataagaatatagataggaattcttttaataatttagttttagcagtcttgtgaaccaattatctatttggttaacaatcttggaaaattatatacaaacatattttaaatgaatacatgttagaaaaattcttgaagcaggtattgtgagtctttttagcaatttttattatatatgagagcctgattttttggtagaacatatgataccagagaaagaaaatattttacatgcaaatacttggattatacacaaccatttagtaacacattaatagcgaatataaaaaaaacaagggctatattctaatgtggtacacagatttgtttgtttgcctctataagttgaatcaacatgtaaaatttagaagactcgtgaagaaatgtggacttcaggcgtatcctaaaaaatcaaatctggtgtcccctgagtttctatcattctttggtctgctgtgcagaagttgcccctttatagaaggcaggtattctccagtttgctactgtgcccaccttagtacttcccttactcaggcaaccttcctttgtccttgtaagtatctgagtttacaactcctatgttatagtatattttgataaaaatttcaaggtttttaagtcagcatgtatttgtttataatatatagtctatagagtatataaatccctcagttatggagttgaattttagagtttagaagtttttaactcttttctttatatataccacaaataattctctgcccataagaatgcctagaagcctttttaggttattcctggttatagttggataatttatgaatattgcagacagtacatccttctcctcagtgctcttccttaaggatgcaagtgacttattggcttgtattatgccagaaataatccatgtggatcagtatgagaacttctattgataagccattatgtttttatttctgatttatattttgtctaaaataaaaaataattttaagtagccatttaagtggaagccagtaaaaatggatttaaaaagtagagctgcactagggtcccgggattaccattataattgagaatagtatttcttactgagttttggtttttaaaatatttgttcttaagttttttaaacctatctctcttacacagaatatactgagctttctaacagtaaagataaaaatctcttctcttgtattaggggaaaaacccatggactatttaataataaggaaaataaatgcatttgaagccaatctctcttaattcaaagctcatttccatggtgacccatttggagcaggagtgcctgacattggcatctgggatcctgacaccattcataaaagtgaatcaagcaagtttgtaccacccagagggaactgccacctgtattgggaagctctggcaactgtatctctgaaactcttaattcctcaaatgttaatgtttgccacaaatagtattgtgaaaggggattaggtgaaattaaagagatttcttgattattggacataaaatacagttttgtaatacttctcaaatacagatggtcatggagtctttctcttgcggtataatacttctgataaagcaaatattctttggaatatagtttaagagacactgctttagagatagtaatttagatcattaattaatgtaaaaaacttaaaatatttgctactgtgtcttagggttttaggcccttgcctcaagaagctcttggtttcagtgggaaacaatgaaatgactacaatgtaccatgataagtgctgtgatcaaagcaaggattcttgggactagtaaatgtttaaagtgagttttggcaatgaccacagttaatccagggagacagaggagggttgtttgcaaggcaaagcacagcacatcagaaagcacagaggagtgagaatgaagggactgcttttcatttacttcctttctatattgtatgttgaagttcaaagcatcctggagaagattttcagttcagttgagaaatatgtaattttgtgaattattaattttttctgctgttttataggacaataataccccacttttatttgctataatttgcaagaaagagaaaatggtggaatttttattgaaaaggaaagcaagttcacatgccgttgataggctgagacggtacagtagttctttttttaaaaataaaacctgagtattctagagtggtcactcaagtcagaaatattaataagaagattaacataattattggcatataatgaaaaatatcaccatgaataatcaggtagacaagcaaatatttggactgagtaacataaagaatagtatatagtaggattcatcttctcttataatatacagagtttggtatttataatcagatgtttttcgtactgtaatcttttattagctaaagggttttgtattagttttattaattttttttttttttgagatggagtcttgctctgttgccaggctggagtgcagtggtgtgatctcagctcactgcattctccacctcccaggttcaagcgattctcctgcctcggcctcccaagtagctgggactacaggtgcacgccaccatgcccagctaatttttgtatttttagtagagatgggatttcaccatgttggccaggatggtcttgatctcttgacctcgtgatctgctctccttggcttcccaaagtgctgggattacaggcatgagacactgcacctgacaagttttattcattttcaaagtgtggacttttagtttatgactactagcattgtcattattattattgttgttgttgttgttttcagcctgcagataactcttatctgacccctagctgatttgactaggaaagcaatggggaaatcttcatctaaatctttgcctactttagataagtgacctcagcacagtttcttggccatcaaaggactataagttagcaacttgtattatgtcttaccccagtgggacaagaggcttccctgttgtccctttcttttagccttggtgacaatttacaaagatgaacacttgagcaccctagatgcttatagacccaagctagtacatgcaaatagttattacatctatactgacaggcggatattaaactggtaaagtgtatcaaactagctttttaaaaaagtctttattaaagttcttgagtggagttatttctttgttgttttaggtcagctctcatgcttgctgtatactatgactcaccaggtattgtcaatatccttcttaagcaaaatattgatgtcttcgctcaagacatgtgtggacgagatgcagaagattatgctatttctcatcatttgacaaagtaagtgtttatgttaaaaggccagttaatgctaaattgaagtttaaaataattgcaactactccatcttatgcattaggtgagagttcatagtttggttcagatagtttgaaatagcgaagagttagtctaccttttagccagaaatcaagcagaagtctagattagttagaagtagagtgcgagattttttctggatttttgagacatttatccctagggatctcaatgttattcattttattctaagtataatccccatgcatgggataaaaagagccatgtctttgatttcttttcctttcctttccttttttttttttttttttttttttttgtagagacaaggtctcactctgttgccctggctggtcttgaacttttgaggtcaagtaatccccctgcctcggcctctgaaagtgctagccaccatgcctggcctgacttttctaattagttattgagtcttgtaatgtccagtttaacagaaaatcttgtattgtcccctggggctctctcctgtgtcttccttctttgaattttccaagaagctaaggggtttcctaagtccaaggaaggcaatctttctttacaagtcagaagaaggggaaaaaaggccattctaatcattctgttgtttccatggactcacttgctgtattattgccattataaccggtcctgcaatctgataatgattgacctttgccaccaggatgccttcactgattcagacccctcagttttcatggtgattcatatatagaggtcaaagctacggtgtttattagtttatgtacttgtgctcagtcattgttcccagcaccctgctctggcagctaggcctcctagctttatccacacaaatattgagcaagttgatgctcaccctacactaaaaaccttatttggagcccacgtcttagctagactttgcctaggccttcgtggtatgttatcctttgagagccatgtttgtctttcctttaaccaatattagttgggattgttctcaatagtcagggatgttcaaataatgttgcaggaagagatcagagttccctgtctcttttgctatcagatctgtaccttgaggcttttttatatcctgtgcagcagctttggttagatagcggaatgttccatgttatctttccactgagtagtgggaaccagcttgcagttggcccctcaagtaatgtgtctctataatcatgaaaatctcctgggctacttgcagctcttcctcaagttttcaatatattttaaaattctacctcacaggaagccattcaataaaattctctgaatctgaagtaagtgagttggatttaatagagctaagcctcatccatgactcatgaatatccatgtatcaaacagggctttgtacttatttcaacagcacatattttaaaattggatcaatacagagcagataagcatggctactgcctagggatggcacacaaattcagaaaacattccatattttgcctagtcccaggaaggccatttgactatttgttgagtagctccaaggaagcagtgtgagcaaaaccaaaacaggtgacacgcaatattgaaattgtgattatcgctatgaaactattgatgtatggtgatctctgaaatgggaacagagctgagtaataaggggatgttacatgttgttagtacatgtcttggaaatgagaaaatgtcaacttgtatttccttcatggaactgaaaaacaatcaaagcagggttttgtcttgtctgttagttggagaggaccatggagatccagcagccaagcacagatctgctggctcagagtttgaggaggtagagaaggagtggtagttgtccaagccaggttttgacacctattagttttctgcccttggtgtgattgatgagctcagtgatgagctcactaaatttatatatatagaaatttagtaataagttatgaattaggtaaaatgccctgaattacaagccacaatgaatacaagtaataaccaaaattagcacttaataacattttctgaaaactgcaacatttgagtattagaacttacagaaaaacacacaccgagcattatttgggattccaaaatggtttcagcaataaagttcaagaataaattattccattgctttactatttctctgaacatataaacatgtaatctcattacatcttccaaacaacctagtgaagtaaggtagcagaatccttgttttttagaagaaaccatggagcctaagagaagcaacttgtctgaagacaaaatacctacagagcgaggtattttggttacagagcaaggacttactctgagtgcaggacactttgcatgatatccagctaactagagttcatttactgagctgtgcttcctccatttatgagtacttcactttcttttcttctttaattataagcttaataagcttgtaaggtttacaaatttgaagtgtatgggacattaaaattctgatattaggtctgatattgcttgaaagtgttttggaatttaatatgtttggtgaatattttttatttcattataaaaatggcaattttatttattacttttgtatacatagaattcaacaacaaattttggaacataaaaagaagatacttaaaaaggagaaatcaggtaagacttctgattgtgaatttcttacttgtcttggtggtcctactcttgataaaatacaaagtaagatgtaagattaaggtagtttcagtcaaaaaagaccagtttaaaaatatgtgtaaattgaatgtgtatatatgtatatacatatgtaaattaatttttaaaatttaacttctttagtttgaaattcagatttatttaagaaggtagttgtagctaatttacaatctcaaacattattgtctgaaaacattcatttatttaattatgatccctaaaatcctatataatatttttgcataaataagaaaaaagatttttaagttagtatgttgtatgtttcctctatagtcacattataacaaattggacttgttatacaaatggatcttcgatttcatttttataataaattgtttatatttagtaaacaaataactacagttgacccatgaataatgtgggggtgagggactctgatccctgtgcagttgaaaatctgagtataacttttgattccttcaccttagctactaatagcccacaattgactggaagccttcctgataacataaacagttgatgaacacctattttgtttttgctgcattattatatactgtgttcgcacaataaaataagctagagaaatgaagctgttagaaaggaaatcatcaggagaaacatattgacttttcataaagcataagtagtcctgacaaaggtcttcatgatcttcaggttgattaggctgaggaggaagaggagaggtggatcttgctgtctctctgttgcagaggcagaagaaaatctgcatataagtgaatccctgcagttgaaacccttgctgttcaagggtgaactgtattacatattgatttgtgtcactaagaaagtaactatctttagaaccaggaactcagcaatccctttctggtaccataaataaatggcaataagaactgtagaactgaaccagtgtgcacccatacaaataggagattattttttgaagacagctactgagcacaggagacggaaaagcaattcctttgtgagaagcacaagttatattacatattcgtacacaagcaaaatgattttatctgtcatagtttacatacatacacatacacacgtgcacatgtgcacacacctgtgcacacagacacaaagttaaaagtcctgcttattcttaatgaccaaatccaactgttcacagagagcggtggataacgcatcctactgtttggatgcaattcttttgactttttgacttgttttgtgatgaactgcctttaatgggtttaaatcatgttttcagttttatgagaaatgaagaaaaagattagaagcaagtaaacaggaactctatggtcagtagtagactataatagtatattcaatagtcatatgtttttctccagttacacaatttacttgaatgatgcacaattaatcaattattattatcataggagatggggtctctctatgttgcctaggctagaatacagtgtctattcattggtgcaatcatagctcactgtagccttgaactcctgggctcaagcagtcctcctacttcatcctcctgagtagctgggactacagttttgtgtggttacatctggcctgatacacaattatttatttgtttatttatttttaatacagggtctccctctgttgtcagtactggtgtgcagtggtgtcatcttggctcactgcaacttctgcttgctggccttaaatgatcctttcaccttagcctcccaagtagcttggactacaggcatgcactaccacacttggctaattttctttttaagggatttttgtttgtttgtttgtttaatagatgaggtctcactatattgccgaggccggtctggaacttccgggctcaagtgatcctcctgcctcaacctcccaaaatgctcggatttacaagtgtgagccactgcacctggccttcaaaattattataaaaaggaatgaagcccagttgagttgcagaaaattgaccactttttcattttttttctagaaacattcatattgtagaacatattgtcaatcacccagattctctattttttattcagataaaagaggattgctgctcatttcacattattttctgacattattttttcatttattccttctatggctttattcaattggatagatatagaaatacgagaatctccaagtcaaatatcaaggcaaaaaaagaaaagaaaaacagattaggtaaagttattctgtgaaataaccatctgattacagttacacgtatcatatcaacttaatacaaatcttacacaatgaatttgtgtcaaggtttcccaagaccaccccaggtttggtggttcattagaaggactcacaggactcaacaaatagtcatactcagatctttaattgataacaaggaaggggacaagcaaaattagtagaggaaaaaggtgcatgtggtcaattctggaggaaacaaggcacaagcctccaggagttctgtcctgtggagttcccgggatctgcttaattctcccaggctcacattttgacaacatatgtgcagtgatgtctaccagtaccagagtttcattagagactaagtgcccaagtttttctatggaggttactctccctcacatgtacccaaattccagactcttacaaggaaagcagctgtttagagtaaatacactgtttctataagcactttagacacagtgagccactcttctcagggaatggtggaaaccctcccatttccaatttcctaaacaccagccaagggccagccttgcatgcaggcctttctaaggatggcagcctcttgcctgctatatgaaatcttttctgcacaacacttgtaaccccaacttaatttttggtgttgttttaaaatttcattttaataacataatattataagataaggtaacttggtactaatttctgttgtatgatccatcttaagttgcagtgcttgttacttttttgacttttggtgatgaacagctatttgtatataagttaccatagcaatgttaggtaattataatctgtcctatttatctcattaacctttcagtaaaattgttaaattaaataagcaaaataatttctgagttaacattagaataaaaattgtcttttattttgattacatgaatagtctagttttcatattgtgctaaatccctgtttagaattatgaaataagataaaatattcaattatttttatcaatattttcttacctaagcatgcaattaaatttatttattttatatattttatatagttcaatttgagaagtaatgaccacatgttgttactttggtcttcaatgatctctaatttttagggtcaccgtgtcttgcttaaatatatcatagtaacaggttcagtgaatatctttattttttattttatttacttatttttttgagacggagttttgctcttgttgcccaggctgcagtacaatgacataatcttggctcattgcaacctccacctcccagtttcaaatgattctcctgcctcagcctcctaggtacctggaactacaggcatgcacaatcatgcctggctaattttttgtatttagtagagatggggtttcaccatgttagtcaggctggtctcgaactcctgacctcaggtgatccacctacctcggcctctcaaagtgctgggattacaggcatgagccactgcccccagccatttatttatttatttatttatttatttattgtaattgttctggagatcctgggatgcatagacagtgaatatctttttgttttttgagatggagtctcactctgtctcccaggctgcagtgcagtggtgcgatctcagttaactgcaacctccaccttctaggctcaagcgattctcctgcctcagcctcctgagtagctgaaattacaggtgccagccaccatgcccagctaatttttgtatttttattagagacgaggttttgccatgttggccaggccggtcttgaactcctgacctcaggtgatccacccatctttgcctcccaaagtgctgagatgacaggcatgagccactgagcccagctgaatatctttttttaaatcaataaccttatttcttagagcagttttaggttcacagcaaaattgagaggaaggtacagagatttctcatatatcccatgcctcccacacatgcatagcctcccccattattactattttccaccagagagtggtacatttgttacaactgatgaacttacattgacacattataatcattcaaagttcatagtttacatcaggcttcactcttgatgctgtacgttctgtgaatttggacaagtgtataatgacatgacatgtatctattactgtaatattatcgacagaacagtttcacagccctaaaaattctctgtgctatgcctgttcatctttccctttctccctagtaactcgtggcaaccattgatgtttactctgtcttcatagttttacttttttcagaagagtcacatagttggaataatacagtggatatctttttgaatagttaaaaaattaaagctccatggcagttgaatgtagtcatttaagatgttctttgtccttttgtttttcttttgcttctttatcattgtaaagaatgatatattctgatgacatatgctttacatacttagaaaacatgatttgtatagatatgtgcacataatagaaagggttgaggaaaaggacaccatgctgtaccacacagcacaaactggagcatcttgctctgtgaggtgggtccagatagattctctagcaatggaaggggacaagtgcaaggggttgtactttataaaactggaatcacaaagtctttcatacttaccttcggttggaaataagaccagacagtgaatgctataggtaagtacataggttcctcactgatcctcttcctttgagggatgaggttgacaacagcctgtattatgatgatgtgactcacctacaactagattctgtcatgagggatagcaagagagttttgctttctgtgaggtgaaaaagaatttttttcccctactagggagaagggcaagcactggaacattctggtagtaaaagggcattgatggttttctttctatatatttttcacatcatatagtactgtccagcagcctgccacacctccctggtgtttcttcagcttctctctgaatgtgaggtgtggttcctagcgtataagctcttaaaggagtgatctttccagtggtttttctgtgggaggtaaaatggcaggtgaatttgggccttgctatatgtagggcagagcaaatagctacaactaagtaaaccacccagcaccttccccaaagagtagtagccagagtaatacattgatctcttttgagctcttttccactagcggctggaaagtctttgcaaggattcctgtttctggtcggattcctatgttttgctgacatctggtgttagggtgttttattctaaactgagcagtttgaactgaagagctagagaggctgtgttgtgttataacaaaataagtgcagtagctcccccttaactgtgggagatacattccaagacccccaagtggatgcatgaaaccatgaatagtactgaatcacaaactgtttttccctatacatacatatctatgctaaagtttaatttataaattaaattgaatctgatgttaccagcagataaggtgtgagaattgaattgtgtcatcagcaggaatgattgcttgcttgttggtggggaaaaaccctccacacatttggtcacagaagccttctttgttgatgattgttgctgtggtgtgacagtagagaaaaatgtgtcaagtatgtctttctgcacgtatagtggataaggggtactactgtgtactctgttttaatggcgcctcatattttggtccagaaatcatgctctttgacactggtgactcatcacacctgttctgctaacaataccatttttactcaacctcatagggtttggctaagatgacttgcatactgcagttcacttgtagataccaaattttaataaatttattcttctttgcatctaataaatacaaagggaagagttcttactgcattaattacctaccaatatgtataacgaatgttaattctaataaggtcccaggcatgctcccaaaggaatgctttgtaacaaagcatcagtcttatgctttaaaaaaccaaaccaaaacaaaacaaaaacaacaacaacaaaaaacaggatctaaagcatacatacaagtgtgcacaatttttttatgaaggtagagtcttactatgtttcccaagctggtctcaaacttctgggctcctcaagtgatcctcctgcctcagcctcccaagtagtttggattagagggatgcatcactgtgcattcttatgcttttaatattctgtacatttgttattgatttaaaatgcattttacctttttctttaatagatgttggaagttctgatgaatctgcagtcaggtaggattttatagatttaaaaaattatgttaactaagaaaatatagatggaagaaacgaatatctgttgagtgttgtattctgggctagacatcctaatatgttctatgcgtttatcatctcataaagccatcacaacatctgtgttcctataacctactgtttattaaataaacaactatggattagagctgattaattgcctcatgatcccatagttaacaaagtagctggcctacagtttgaccatcagcctgcctgccttccaaatcctgtctcttgctcctcagcatagattgacagatatctgtgcagcccttggatcaaggtataggtctgaatcagattagtcagattgattaatttgattaatgtctaaattaatgagagtttaaataccttgaactctcatttaagtttatcattagaatgtggttagtccaagagtttgtcctaataaatttgacaatttcagtggtaaccagtatcttatttttaccatcaaaggctctagggcagatcttacttagctttgccataggggtgtaagttttacaaaagcaagtttaggcaagtcttagagacaaattatttgacttcccagtttggttttccatttaggcaagtatttctgcttacttccataatacattttttagtcttgttgctttttccgtgacttttctataatcttgccttcattttttaaaactttcttctctgcttttcttggtatttcttttgttctattattttttcaaactctgctggctatgtattctaagtttttctatagacagaatcaagaggacatagaattacagaattttaaggaatcttggaatgaattaaaataccttctagtatttttacctgtgttgaacattctggtcaaatgattctctagatagagaatgtgaggctcaaagagtttaggatgcttttttttagacataggaattggcagaaatgagatttgaactcatgttaaagcccagtactcttgcttctttttatatcctattggcgtgtgttttaataatacaaacgggagtgagtctgtgggtagaatgagaatggaattagctggggaacccaatggaagtagataagaatggaatgagcaggggaagtccaagtttgaagataaacaacactggattggataggagtacagactcttctataagagatcaaaatattggggtttatgacaagtttgataaagataaattataaaaatgaaggacacaagatgttgggaattatctacgaaggcacattaaaatagaaggttcaagggagctctaaaaagtttgctgcttttttttaaatcaaggactgacaaacttgaagatttttactgaaagatgctaaaacattttgagacactgggaggagcgtctgcagcagatagaaatgtggtgtcatctacttccatcctgacttagaaaggggtggcttagagcccctggagtactaaggggctggagattgctgaactacatagatctgtggcccagtacaggtgtctcctcacctctgcctcttttcccgattcactgatgtccttcccatgtccatgtgggctggttcaggggcatgattggctggcaaatcagtcatggagttcagttgggtagttggtagtgtgtctagctgggggcaggtgatggagactccagttagcttgtttttcaggagcagggatatagagagctcctagtcctggtcatttgaggccatcctttcaggaatctgtgctttcatagactgaagatttaaagattggagacttctgtggagccctgcagaagtggaatctggaagtgggagcccataggaagacagatacttagagagtacttagggaaatagaggtacacctaccaggactctgtttttttctgacagtctctctccttgggtgtctgagtgcctatgaaaagttttaagggcttgctagtttatgtggacctgaataaggtaggacctatagggtgaaaataatgggattttataattgttaatatttcaatctttctgggaaaagtattctcaataagaacatacacctttgttatttgacttctgtacatttagctttcatacatttcaaatattgtaggggctttcctgtactgatttagggcaaaggaaagcaataggaccttcctaagtgggttccatgctgaggaatcaagactgccatattgaagtgatgcagattagtcttttatccagagacagatcatggaaaagagacagtggatctttctaccttgttttaggttattagttttcttccagtttaggtaacaaaatttatgtcatccattaattgaattttaagttcagcttcaggacagataatttgtgagggcaaatcattgtcaggctctgccaatttattgactgtcactatttgttataaagctcaaggttagttttcattgaatattttatagatttagacaagtggaggcagaaataggtaactaaaatctatttttagaagaggacatattttaattatatcaagaatcactatttaatatatagattgctgacctttccctagattatggtttccttttttgagggggaagctggatataaactggcagttaaaaaaattgtaaagaaatcaacttgctcattttcgttgtgtgtttttgctctcaagcattttccatgaactgcgtgtggattcattgcctgcatcggatgacaaagacttgaatgttgctactaaggtaaagtggtctcttgtaaaattaattttctcactctgaatgtacttttgcatagtatttacttttcaaatttagcagtggtttacctatcattgttttatggtggtaatggaaagttggtcagagaaaaacatacatatggctagttgattcaaaaaatgtgtttaactttggtaactaacaaagattgataagtactgtgacagggtgggagctgaaaaaaaatgaactggaaaattagtagtgacaggaaaatcacattaggaaatgctttctccaatagaggaaatatgaaatttgcttaaggtttatttggataaatactaatactttgacttttaaatcatacgagtgtgactttcttaatatttatgcctgtataaatcttcagtggatcaaattatttgcagtaatcatgggatcctcctggtgatttttagtggcaagaatattcagcacatagcatatagcttttgttcttggaaacttattattttggtatcatattgtttttacgagagattgtttttctacttatattattggttctgtagtgagacaaaaaaaaaataaaaattgtagaaaaataactgagtgtggtggtgtacacctgtagtccctgctacttgggaatttgaggcaggaagattgcttgaacccaggagtttgagaacagcctgggcaacatcgtatctgatttaaaaatataaattgtggaaatatagaaatttaaatttatgttctcaaaatgtgtattgcaaaggaatttttgtgtggtttatgagttgtccatgaagagtttatataaggcacttcatctaattgaataacatgtattttgctgcaaataaccagttctagaagcagagactcttaataccaatggatggtaagactttatcctcataattttgtcattgtagtttatttaaaatatttacttcaccaggtgtggagactcacctgtaatcccagcagttttggaggccgaggtcggtagatcacctgaggtcaggagttcaagatcagcctggccaacgtggtgaaaccctgtctctaaaaaaaaccaaaaccaaaacaaaacaaaacaaaacaaaagcagaaaaattaaccaggcgtgatggtgcatgcctgtaaccccagctgctcaggaggccaaggtgggagaatcgcttgaacccgggaggcggaggttgcagtgagccaagatcgcaccattgcactccagcctgggtgacagagcaagactacatcttaaaaaataaaatagccactcaaagtcctcatatcatattctgaaattttgaatttcagaaggttttctatttagttgtttaaataatcattggaagctcctgcataccgtaagctactggaggtcagtaaacatatttgtgtgtatcctggagtacctagaatacagtcttccatgtaagaagcattttagttgttgttttttgagatggggtttcactctgtcccccaggctggagggcactggtgagatcttggctcactccaatctccatttcctgggctcaggtgatcctcacacctcagccatccaagtagtttaaacaatagagctatgtcaccatagacctgtgtcaccatgctcagctgagttttgtagagacagggttttgccttgttgcccaggctggtctttaactgttgggctcaagtgttctgcctgcctcagcctctcaaagtgctgggttacaggcataagacattcagccttaatagttgtttaatctgaataaatagacaaatgaatttttatataatggaatgttataagtaatataataaacctaatgtatctaataattaaatattgtatttaaaatattgcttacattgtattttttaatatttaagggtgtataagttttgatatgttatgttgagaaattatgccataattaaaaaggaaataaaatagaaataggtcatcagtagaaaatagggttacaatatattttctagtatcattcaactggaatcttaacattgagattttagattaacatttcttaagctttttattagctctaactcatgttctattaaatatacgttttcaagccatacattactctttattattcttatactgtaagttctagggtacatgtgcacaatgtgtgggtttgttacatgtgtatacacgtgccatgttggtgtgctgcacccattaactcatcatttacattaggtatatctcctaatgctatccctccccccttgtccgccccacgacaggccccagtgtgtgatgttccccatcctgtgtccaagtgttctcattgttcaatttccacctatgagtgagaacatgcagtgtttggttttttgtccttgcgatagtttgctcagaatgatggtttccagcttcatccatgtccctacaaaggacatgaactcatccttttttatggctgcatagtattccatggtgtatatgtgccacattgtcttaatccagtctatcattgatggacatttgggttggttccaagtctttgctattgtaaatagtgccgcaataaacatacgtgtgcatgtgtctttatagcagcatgacttataatcctttgggtatatacccagtaatgggatggctgggtcaaatggtatttctagttctagatccttgaggaatcaccatactgtcttcctcaaaggatgaactagtttacagtcccaccaacagtgtaaaagtactcctatttctccacatcctctccagcacctgtgggttcctgactttttaatgatcgtcattgtaactggtgtgagatggtatctcattgtggttttgatttgcatttctctgatggccagtgatgatgagcattttttcatgtgtctgccatacgttactctttagaattctggtgaccaatttttttctgggtggaaagttgattgaaagttctagttttctctctgtgttataataatgttctttcaggtagtggtcgatgaccatatttagctaattgaatgtcttatagtaataaactatatcacagaagtacttacaaaaaactaattgtagcataaatattaattagtattatcagggatatgaaagagcaaaaggctctgttatagatctatttccccatgtactttattgtacttcatgttgtctcttttctttcttggcttaagctcatatttcattgaccaattaggcttgttttttgtttgtatctctcttcattctcatattttaaattgaaatttttggggagtcagggtcttgctctgttgcccatgctgcagtgtagtggcatgatcttggctcactgcagtatccacctctcaggctcaagtgatcctcccacatcagcttcccaagcagctgggactacaggcgcacaccatcatgcctgactccttttggtattttttgagtagagatgtgttctcattatgttgcccaggctggtctcaaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttggggggcagaagtggaagatttacttgagctcaggagtttgagaccagcctgggcagtataatgaggccttgtctctgcaaagataacaataaaaacattagcatggcatgaagggacgcacctgtagttccagctattcaggaagttgaggtgggaagattgcttgaggtcaggagtttgagacaacagtgagccataatcaggcccctgcattctagccctgggttgacagagtgagacccagtttcataaaaagagattgataagaaactcttgatgcaactcattataattttaaaatggaaactaattcttgatattaccttagcagtgtgtccccgagaaagtgtcagagcctttacctggatcttcgcatgaaaaaggaaacagaatagtcaatggacaaggagaaggtgagaaccgtattttatttaaaaagtcttttgatggaggccgggtgcggtggctcacgcctgtaatcccagcactttgggaggccgaggcgggcggatcacgaggtcaggagatccagaccatcctggataacatggtgaaaccccatctctactaaaaatacaaaaaactagccaggtggtgttgtgggcgcctgtagtcccagctactcaggaggctgaggcaggagaatggcttgaacccgggaggcggagcttgcagtgagcggagataccaccactgcattccaccctgggcgacagagcgagactccgtctcagaaaaaacaaaacaaaaaaagtcatttgatggaatgtttctttgaaaatatgagcactaatagagtgtaatagctaaagaaagtgtcctattaactgtataataagtaaaggagaagtgaaatggtgataagttgtgtctctaaccaagggtcagcagttgattctattgggagtaccactaaaggagctgaattgtgagttccattttaagatactctaagacctgaggcaagtcaggagagagggaagaggaaatgaataaagagaaagaaagaatgaggagagcggattgtacatggaataaataaaaaagcatatgcagaggtaagtaagagaggatagtaaaggcaaattgatctgtagaagaaggaagaacatggtgttagaaacaggaaagaagataaagtgagcttccagtaccaaaatgtgtcagagaattacagtaacattttccttctcttgctgtcatcctcgctactggggaggcattaaggattgaggcacctcaccacacagacctgtgttttatctaccatagatgaacatcaccaaagatggtcagccatgtatggctataatttgtttttatagaaaatgttgtaacctcataggatagtatcatataggccaaattaacataattgaatagtgttgggtgatttatggagaagaaattaattcaagaagttattgcctgattaaaagttcattagaaacattatggcttataatgtagtattaaattgagggacataatagggaagaaattgaggctaggccaaaagggcaattaggggaaaccaatatggaagcacatcagtgtagaacagggcattcaaattgtcatgaatgagttgaagagcttctggaaggtgcacattctgattcagcaggtatgggagtctgcatttctcatgagtactcaggtgatttttggtgctggtccttggacacagctctgaatagcaagggaatagccttcctttagagaactctggaaaaagaaccattggagagcaatttaaaaaataacagaatccagggaaagcattaatttccttttatttctgagcatgattctagccacaggggaaggagaatgagatgaaaacagagagattacaggtgtatactactgctgaatacagatgaaaaaagtggtcacaattatccataaaaagcagttaggaagggaagcatcaggatgacagttctaaaaatcactgtttcaaaggaagagggattgtgaaaggacacggagggaggaaagaaagacatttgctggggtcttgggagttgaagccaagtaaacttgagacaactcacttccagttgcttcagcatatgcccagtctcacaaaagaggttattgctgtggagagtactggaggcaggagggagtgctagagttggggtaaaccacagcagctcatttcacttgataactgtcaggcctcagagagagaagtttcactgacatgagtgaataagatgtgattaagttgcatatagatgctttggctaattttttttgatattacaaaattcattctgtgaataccaaaattctctttttcaataaatactgcactgattttgaaatataaatatgtattcatatccagcaagtctgtggtaattcagtgttttcttttttgataaatattttgatatcggaagcttattcgacatggtttattttatgtgatccttgcatgagtggatcaaggagctctaactcaaggccaaatgaggggataggagaaatgtaggtgctgcagtagcccatgtgatcatgggaaaaatgagtagtttgattagctgtcatttcataagtgtgtatactagctgatcaatgtagaacactttctttgatgagaggtgaatcacacattcacctgaactgtcatcccaactgtgtatttcctcagtgacaagacaaggggaatttgtttgtggcatgctggcagcaatgcctctgctgtgttgagttaaaatactctgtacattcaccatcagctttgacgtcgattccctcaggtttgatttgctcctctgtttaatggtcccttttctcctcatcagtccacatgttcacggtgatatccatgcttttctattttaggtataggcatttgaaacataatctcactactgaaatgtaaactgtgcattttaggaatcctatattcctattttcctcattatgtttctgtcatgttgccgtcctaggcaatgaaaagatgccaagaagaaccctcaaaaccttaagtaattatttttatagccaggcatgagaattcagctcgatagtaccactgcatgaatgtttggttggccctgtcatacttacatataattgatgacatatcccctttgctttgtagggcctcctgcaaaacatccttccttgaaggtaattaattatgtatatttttgaatcactaactccatgttgtataaaatatatatgatttatgaatcattttcttttaaaacccattcagcctagcactgaagtagaagatcctgctgtgaaaggagcagtacaaagaaagaatgtacagacattgagagcaggtacatttaatggaatactggaaataagtacattcaatgattggaagtactcacattattcttattcctaattctatttgttcaaaattgaatggaaggcattgacataaatgttattgttggtatccatatttgaataaaaataaatttagaagcataaaaaagattttaaaaatgtaacctttaactcagatgtttctcttttaatgttttgaatagcatgaagttttcagtataaaatttttatacctgtcagggattcaaagcagtgaattttgagactctaagatatttccaatgagttaagtgctacttggagttctgaactttacctagaggaaagctttacttattaacatgtcagattctgttttaactttagaggcttgctgctagtgttattacactgatgatctgaagccaatcagatgttctaatgagcaagactgtgtgtgtaggtgtatatatagctgtgtgtatgtgtgtgtttgtggcatctttgactattaaaaatgaggaaagtaatgattcatttataactggtagacacagtcttttaaaatggtgattttgagactttttggtgttaaggtttttaaaacatgattgcatagaggctaccgacatcataagttggttgtttttcatttcaatgcccttttgaaatctttaactatattgtgatgctcagaaataatatgcagaattttttatttgtgtcccaaaatggtatgtgagtggttatacactttacatacctttctgccactttctttggtgtattttgtattatattttccagatatatccacattgatatgattatctctggtttaattcattttacacttttcattgtattcccttataccactttaccacatttagttagactctcctgttgctgataaatgaagaaagaaagaaaaataaaaataatgtcagattaagtgggcttttctttaatcagtttgtatctattaatatttactatatgagagtttaaagttgaaaagttcagaatacaagcatgcaccaccatattttataaatgcccttagaactgtgactcatgagcctttagcctatgaagttaggacaattcatttctctgaagaagtttgttgtgctgttctcagaaaagaaaactgaaaatagcaaatgatattgtcttatttgacctcttggacatctttgaatgaaactgcaactccagggatactcagatcaaaattcagaagtaatgttttgaacaatatagtttgtgaatgtccagtggatcatgagcccttgatgggaaaatgacctttcaagtttcacttttgcattttttgctcttttccttgacttgtcttaaaagcttaaattcaaccgttttatttttacagaaactgggaatataacttttaaaatttatgtctgtcctgtctcacggtgttgtgtactcttcagatcttgtgtgaatatagacttatgtgggaacaattaggtgttttgtttgtttgtttgtgtttttgagacagagtcttgctctgtcaccaaggctgcagtgcagtggctcggtcttgactcattaccacctctgcctctcgggttcaagcaattctcctgcctcaggccctcgagtagctgatactacctgcatgtgctaccataccctgctaaattctctatttttagtagagatggggtttcaccatgttggccaggctgctctcaaactcctgatctcaggtgatctgcctgcctcagcttgccagtatgctgggattacaggcaggagccactgtgccaggtacaaataagatttttaaggctattatattttatacaattctttggtctatgtgaattctgaaggtattcatgcattgagggaagatcatctcagtttaatgaaagcagtttttaatgtatattcattaaaaatttttttgaagtttttgtctctagtacagagaaacacacaatattgtcatgggtatttgaccttaatgtgtttatgcacaaacttagttattcaaatattttcttatccctgaagaatcctaattattaataaaaaaatttctcatggaaaacaacatatataatagagattgttgagtgataaagtaaattgtagtaaataacagaagcttagaacaagttaagtaaacttgtctgagttaatagaaattacaggacttttaagatacattagaccatgagggagtagtgtgtttgtggggtagaggacatcatggtcctgcttcagtgaagaaagaacttttacaccttattacaatttgtattactatttacattctaataaaaactttattttcagatattttagattatgtttctactagttgaaccatcaatagtaagacttttcaaagatttgggaagttgtgagttgatgataaatatctgtatcaccattcgtgatcaaaaatcagcaactacaagactttggacacacgaacttcatagttaaagaaaggattaatcttggagctgtgtttttatcagggaattatactcttcattacctctgtgaatcgcagttattagagtagaaagagagcaaagaagggaaacaaacatagaaaattttattctagattacctcagttggcttcatgctaccatagttctggcttttaaaaagtcattttgtggtcaaatgtactttgtgtttactccctttatgcagcctacaaccaaacaaaatgcttcttagcaaggcatttgtattcttcccttaaggaaagcaacatataaataacaaagagaatgaggagaaagagtaatttcattgaagttggtatttaacataaatttgtgtgcgggtaccatgattatatttagaattttgggcctggaatagaaaaccagctagacgtctacagatttcctactcaaacacaatgtgcctttgttttatttttacatctgtaattttgcaattattaggtacaactctatgcagtgtcactaaaaataccttccaaaaccaaatattaaataatgcctatggttttctgtattataatgttgatttccccaatattaatgggaaccattgagcatttgccttgtggtgtctcctgagctgtattcacacattccatcaccttgtcttaatggataatcatgcactatgagtatgggttttcagaagagctgtatcatttaaagataacacaggagcatcaaatttaattctgctagaatacctggtctattgattaactgcagctaatatggggtctacttcacatacaagttaaattcagtgcccttaatcagtcatatggtcaggtcaacagtaataaattatgcaatattttttcacccctatagttttaatttctctttccccttatgtctagaattaacattttattttacaaaacatgatgataatcttctagagtagtgatgacaaagtataaatccaaagtttcttacctatgcaaatgacttgtttgcttctattttctcatgagcttggtagatccaggaaacagaacttttaaaacaaaatccccatatgtggctgggcgcggtggctcgtgcctgtaatcccagcactttgggaggctgaggcgggcagataacctgaggttgggagtttgagaccagcctgaccaacatggagaaacacatctctactaaaaacacaaaattagctgggcatggtggcacatacctgtaattctagctactcgggaggctgaggcaggagaatcacttgaacctgggaggcagcagttgcggtgagctgagattgcaccactgcacttcagcctgggcagcaagagtgaaactccatctcaacaacaacaacaacaacaacaacaacagcaacagcaacaaccaccacaaaacccaaatgcatttccttggcacagtaaaactgaaacagaaaaagtgtaaagtaaatacaagtaactgaaacagtttatgtatattattttacttctcatttgataaaatttgtaaagtaatgagcagagtgtatttctccagggacccagatatatacatttattcattcaataaaaattcatgcttacaatggccactgatacttatgtcctaaatatttctgaaaacatctcctcaggcctgcatcatctttgcaacactgccttatattttatctttgttcattgatttatatgcctcagaattttatgctcctcacaataattagagttaattatctctaatgcaaatagatctgtgaaccactcctgaatacctatgtccaagcatcttaaagttttatataaggatttcagaaactgatttctgggttgggcatggtggctcgtgtctataatcccagcactttgggacgctgaggcaggtggatcatttgaggtcaggagttcaagaccagcctggccaacaaggtgaaaccccatctctaatagaatacaaaaattagcaggtggtaatggcacatgcctgtaatctcagctacttgggaggctgaggcaggagaattacttgaacctgggaggccgggttgcagtgagccaagatcatgccactgcactccagtctgggagacagagtaagaccttgtcccaaaaaaaagaaaagaaaaggaaactgatttctgcccaaatctccatctgtagccctttccccatctgcctttttctctggaattactgagctgctggtaatggccccctcaccattcctcttttgcagagaaatacatactctcttggaggcttctctccctctcttgttgctgcctggcatgtgctcaccctttcctgccctctgcctcacttaatctggctaaccttactctctaagtctcagctcatgcatgatctttaggaaagccatccctgacagcttttattttccttccttataccccagtgcctaacacttagcaggaactcaataagtaattatttagcaaaattaagactgtttatacaaagatgattcaaaagattgtcctctacagtctaacagcaaaggggatcaacatgtaaagacatgatgtgcagttcaggtggtaaagtgacgctggaaaagttgacaaagtactaaggaactccaatgaagcagacacctgtgtgtgtggagaaagacagctagaatcaaggaagacttcacacagcattctgagcctttttttttctttttctgttgttggagacaagttcttactctattacccagggtggagtgcaatggtgtgatcgagactcactgcaacctcaaactcctgggctcgagggatcttctcacctaagcttcttgagtagctgggactacaagcacatatcaccatacctgtccaattttttgtagagtcaaggttatctatggttcccaggctggtcttaaactcctggccttgagcagttcccccattttggccttccaaagtgctgggattacagatgtgagctattatgcccagcctactttctgagtcttaaaagatgaaaataaatttttcagaatagtaggggaaaacatttgcgatgtaaaaaatggggtgcacactaattaaggtataaacaacaataattttgcaaattattagtaactgccaactcaattagtgtcttgttaaaaagatactgttatgaagtatagtaaagtgttacattgtatattttgactgtatttcaaaattttgttttgtttctaacagttttgttgatttatgttgggtggaacaatttgtgagtgaccctgagatttcatatggcttgaacctggtgatatctaatgtctccccaagtggtttgttgaaattttggatgattagaagtatttcttaaagaactaaatatttcagtaaacattaagcttcattgaaactctcaaaatataaaatacaaagaaatgttattctctatttatttttatatagattatagtctttatctaactgttcttagttcatttgaactaaaccaatgaatttgtcaacagaacaagccttaccagtggcttcagaggaagagcaagaaaggcatgaaagaagtgaaaagaagcaaccacaggtatatgaaaattcaagtttcttgtttaatattgggttttgtttttttgcttcagtaacaaagcatagtccaaatgacatgaccttttagactatacctttagaatccgatagatcataattttatatttaatttttaaaacatcttaaccagttatgaaacttaagatattcttactatctctagtaactattagttattctggtaattcttactatctctagtaactcatagctgtctttacccttggaattgaggcaagacattttcagaattatcttgctcttttattgttataaccttactcataatacagaaggtaacatgaaatattgggtcatattattaaggaatagaaattgtgaacaatttaacaatgatggccactgagttaaactagtgttaaaggagtcatcattgccaatggttcaaatgttgcagttttatattgctggtcaccagtgccgaggttaaagatttattctgttttgtggtcaccatttgacttctgtgtctgtgttcagggagtgagtggggtcataaaagtcaacccagttgcctattaagagaatcctaccttgtggaatgggacctttggtgtcagggtacaaacaataactttattttgacataaatacatagtaaatgttactaaaatttaaaaaatccatccactatcactagtggaacttaaaatatattagaagtggatataagcagataatccatctagatacataacactatcatagtatattatttgaattagaatttaaatttttgcttccctttcttattggtgttcagtttggctcttaataattcagtgtttgcctagtctgtagttaatcttcagaaatatacacgtactgtaggggctcactttttctggtatgctgaggtaaaatctttgtaagagaggaagattttataatactacctatcagctttgaattcatttctggtagattttacacataatgcattaagtttaatccaaacaaatgctaagcgttcagcttgccagttcatatttctgtcctatgttaagccaaggcaaattatttttcactttttagttacaatcccataatttaagagtggcaacacatagattaagtttcacagttaaattttaattattttctagtatttttgtttatacttgattaaagctaattttaaaacatgcactctgacagaaaaggcatctgagaaacaaaacaagcaaatttgttttccattttgcacctgccaaaaaaaaaaaaagtctcaagaaccagaactgggtaagaattgtgataaagggaataatctgtctgtatattcacgactttctttaaaattcattacaaacaagttcaagctgaatattggtgaaagttttgaaaactccagaattactgcttgccctgaggaagagctcctacatagtaactctaaagagggacgaacaaaaaaggagtgccctctaatctgatgaatcaggtccctgattgtgaggaggaagatgcatctggagggtctaactctgtggcattccaggcagcgcctgaacagaggaagcccatgtcaaatgtctttttattccattcatactccaggtccctgaaatacagttaccagtcatcttctaagcttcatttaaatgaaaataaatcagactataaaaatgatagcaaaccagacacatagcttgtttctaacacagatgatgaaaatttttgtaatgatactgaaaccaaaaaattaaggaacccagtaattatgattgaaatgaaagatgattaagagtttgacatgcaaatggcaaaaaatgtaaacccagataccactaattggaaattggacattaggcattggcctcagtctagagatccagaaagtctttttgatttgttgtttacccaccccaaagaaatgaagcatatgattcagatagaaagccacagtatttctgctgctacagatacttataaaaacagaaaaccaatacagcgtttattccagcagccactatatggcaatcccagtgctaacaactacagaagcatgaatcttgaattataaaatgtgagttattctttaccacatagtgagagaacatcaaaaatatagctagaagacttatgggaagatattccaaggtcaccaacatggcacatgaatagatatgtaacaaacctgcatgttgtgcacatgtaccagaacttaaagtataataataattaaaaaaagaatgaggtaggcatgttacaagttgagttcctggctttggagaaaagcaagtccaacttcaaaaagacagaggttcacttgctgcttctttttcctctttatcaattatttgatttagtcaaattttctattcaagaaaatctcatgtgtacagttacagtggggttatctaaatgtgtaattatgtgtcaaagtagattagttctgctatctgaataatggttctggagaatgttctcataatgtttgttcattaatcaacctatgtctcactatcagtcttccaagtggcgtatgagctgggaaactaattaagccacataccatgtgaccttctgaaccagatcaacataaagaaattgctaaagaaacaagctctagattctagattcttttttcttgtattcatttagagataatttacatttatttaatgatagaatgggaatacaatgggagggaagcaatgactgagacaagccacaaaaacacgtctagccttgagagttgcaacgaatattcccagccaaatgagtctgtttaatgtgttttcatgcatgcaagtttatctgcttagctcaaactgtttgaacttacagtcccatcatggttatttccaatatttttgaaaacaaacatatacttacacatattttaaaaaatcaccactctgcaatatttctgttgaatcagaccttacgttatgttgtttaataaagtatggtaagttttggcatgtatgatttttatcatataagaagcataatttcttagccaaaaatttagcctttgactctttagtagaaagttgagttctgtacattgtgttctaaagatagacaaaaatctagagattttcttctttcaaagtaaaagcagatgaggcctttttccaccctctgaggcattaaattgctttgctcaagttagacttttaatatatctaatttgataaatttatctggtaatttatgtaattcagcaatatggaattgtatcatgttatatggtgccatgaaatgctagtgaatgccacctcaagagctctggatgaaacatttaatatgtcttggttggtttgactcccattatcagtagataatggggttaaagtaggtaactgtaccatatgttttccacctataaacttttgtggtaattgaatgtgaaatctgggaagcatctcattttccagaattctgcactagaaactcagcagtttcactctgcttcttttgttgtggcaaacgttggttcccataattcaaagagaacctttacttttttgatatcacaggattcaaaaaaaaaaaaagagagagataaaaggcagtggggaaaagagtagctcagtacagaaaagggaaaacttctttactgttcctgaaggcctacaaggtcacatcttcttaatctggctatttcatgtaaaatccaggtagtaaagacagaagacatatattatgcctgtgtctttttatttctctgtttctgccagccagatagcataaaaatttataccagatagcaaagagtggatgggaataaaagcacaaaatggagaagagccctttttgaaattttggaaaattcttctattccctcaaacagaaatgagcagatttgacaaaaatttcgatgataaaataagagtatcttataattataataattatgtataatgataaaattaaagtaagcacaaaatacttttatcattaaagtggtgatagttaacctgaatcaagtaataaaaatcagggaaaaagttctttttattgaataaaataataacaattattattcatcttttattaaaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgataggtaagcctatagcagtgtttttttgtttgtttgtttggttttgggttttttttgtttgtttttgtttttttgagatggagtttctctcttgctgcccaagctggagttcaatggtgtgatctcagctcactgcaacctctgcctcctgggttcaagcgattcttctgactcagtctccctagtagctgggattacaggcatgtgccaccatgcccggctaattttttgtatttttagtaaaaataggatttcaccatgttagccaagctcgtctcgaactcctgacttcacgtgttctgcccacctcggcctcccaaagtgctgggtttacaggagcgagccaccgtgcctggctgcctatagcagtatttcacaggagataattgtcattgtgctataaactaattgaaaattggactaatattccttatgattaacaagttttatatttttaccaggggtatttagccctgcctggtattcagaaaaaagcaaattaacataaaataagatatattttgtaaagtcatgctgatatttaaaaagtaattattagtgttggcaaatgtgaggaaaaaggcattctcatacactgttggtataggaaattagtaaattatttctgaagggtaacttagtgctgtgtatcaaaatttcaaatagcctgacatccctttaactcaacaactccacttctggggctagatttcacaggaaaacataactggtgtaaacatacacacacttattaatatataattaacatgcattaattatatattacacataatgaacaataggttaatgaatatataaaatatatgtaataagaaggtgaattgaaagtattaagaaagaaatataaaaagtgtggggaaacagatgttagactttttagcctagttttggatgacagtcatctgcagatatagtttgtgtgagagacatctgaaggtgtcatctcactctgtaaatcatttggagaaacacctgcaatatttcataaagatgaaaatttatttctagtgaacttatacgcttgtcaataaatagtaactttaaaaatttagttgattgtaaatgatcttttctaattagggagtaattatgactgtgtgatttaaaaaggtaattttgaacctgtaactttactgaattatctctggtatccttttttataatatatattagagtgactagtaacaaaaactttagcagaatattctttccttactacttttcaagtatatgcattcatttgaagatgttgaagtgagaaattaaatatctgagaactgcaaaggaaaaataatccagaacatagaaattttattaggataataaacaacatctgcagaggtagataacaggatgaactccttattttttaacaaaatgaattttaagacaaatgtctttatctgcagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggtaaatcaatctttggtaaaaattctatattttaaactttatcttatcactgttacttataatatccacttgatttaatatatattgtttaggtctaaaaccataaatgttatctcatttttaaaaatgaatgatgacacttacaggtacaattattaatatttattataaatcttggcatccacataggatattattttattacaaagagcttttgaaaacaataatatgccataatttatacttagtgataacctattgataaaaattttgttccaggtaaaatttttccttgtactttcccctatttcatattgattactgcacctaatattataaagaggaaacagaaattattgcaatcgcaaataatctcatgatattctaagaagagctctataaattttatcttatttactattggcgttttgaaataaaagttttctttcgtattgatgtatttacaccacagaagtaactgtgatctgttggagaactagaagtagagtcagaagtcctggggaaaatcctgtagcttgcttatatttttaacatttctttttcaaaattatggtaactagatgagttcatcaatgaatgtatataggagtgactagtataatgtctagtttatgatttagtgaatgtaattcttataactgactataaaagtgttaaaagagtcaaactgaaatagaatgttatcagtgaaacagaactgtaataactctgggaaattttatctgtccaaatatgtgtgaacaaaagttcttactatagggtggtgtatgggttaggtatcaaagtgtaaatgcaattttttgatatatcttaatttagtcaaatttgttaatgctttaatttatgcttttgagtttgttgtaattcagggaaaggcttttccaattctgatattcttaaaaattctctggtgtgtgtgtgtgtgtgtttacttttataaattcattgactctaaatacatttctgaactttctggaatttatgctctataaggttcaaagttttgcttcaactttttctccaggtggatatccacttatggtaaactttttagtggtacggatgtgcaggttattctttaacttcagaggtaatcatgatatgttattttattgagtactagctaaaactttcttttgttttatttaggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagaaaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcctcaaaggccattggaattttacttttattctgagataggaatctgttggaaggatttgaacaggtgattgaatatgttaggaactttgaggctgagttgagcttctgagatgattgaatgttggaatgaatctgttgtgtaagtaagagaataccaatttggcaggaagagaacatattctgcatccctcactgaattcagtaataaataaaaatgtgtacatgtgattaaaagaaggtgaattgatatgtgtggtgataattttcaaagtagatatgttagaattaaacattattaacataatttaataaggcagtttataaaatcagtaacaaatattttatcaggtggttgtgagacaacttcaacaagaagtggctgacagcgtaaaaaaattaacgacgttagagtctccactggaaggtatatcacgttgtcacattaatttggatgagacacaggcctcaaataagaaattatttcaagtgaaaagtcaagtatgtatggaatttaacatgtcaacagttattctgtagctagttgaattatataacgtgttttaggatactaattttggcagaagcttgattttttattttcattataatgaatgatttccattttactatctttataatgtactatttttttatattgtgactttcattataccattttgaaaaaccattgcataccttttctcttacaatatgtacccttggaaaagttgagaattatacatcattcctcatagaaaattgacttttttcctgttaaacagtatttttaagtaatttgtgtattgctctgatgaggcaagccagattaaatcagaggagaatgtttcatggaatgttccagaaaattgtcttatttcttcacttttgtgaatggacacagaatctgtgtctatttgtttcacagattctaggttaacttgtacagaaaggccattatactattctttgaaatgtgcatgttttaggttaatttacaaactatttgaaaagttaggcattttctttatcttttatttaaaatatactgtaaaactgtagaaatatttagatttgatatagcatgtacatcaaaaattaagagttgagaaaattatcttgatcctgcctttggattttaaaaagattcactgagatgtcattcacatatcagacagttcaaccatttaaaatgtacaactcagtgtctattagtatgttcacagcattttcgtcaccctgaaaagtgaccccacatctcctaggcatgactgcagccttcctccatgtccctccacctacccctgttgtaggcaaccaccgtctacttttgtctccatatgtttgcctgttctgcatatttcatatacatagagttatacaatatgtagtcctttgtgactggctttttcacttagcataatgttttcagaattcatgcatgttttagcacacattcgtagtttatttcttcttatagttaaatgatattctattccatggctatactggttttccattcgttcatcagttgatggacctttaggttagtttccactttttagctattatgaaaaatgctgctgtgaacattcacttacaggttattatgtggacacgggtttttatttccctgccattggactttatcctcagagttaattgggcagatttcagcacttgtcttgctcatgctattctttctgccttctcagtttctgttcatctagcctcattcattcagacctggcagacaatttttttgttttcatgaagctttctctgactgttctgtcattgaccttatgtgttagcaatcgttgtctagtctgtgctgaaaaacttagtccttaattttacatggcttttatttttttatggaagataattttctctcattataaatttgcttaatgggggaataatatataatgtgtatgccacctatccttgcatacattgaaaatattttagcttagaagtttgtagcatacaattcaatcatttataccataccaattatttcttctttgagaccttgacacagtaaggttatattctaaatatatttttagcaattaaatatcaaatctaacccaattagtctaacacaggagatgcgttcaatcacgtgtttatgtttttctctctatgaaaaagaatataaattggccttttttcactatgcagccattactgtgtttctggactgctcccagtctgtcagctgaacagttctgggtgcagcttgtctgatgaaggatagcacagcccctcaatctgagtgctcagcagagtgcttgtgaaggcagcaccacagcaacagttgctcagagggaacggattcaggagccttgacttagcaatagagtccagggttttcagctcagtgtctttagcctgtctctgctggtcatgtcagttacgtactattccatccaggaggtgctatttacattgtagtacatacacagtcattgcctaatgagtcatacagagagaaaagtaagttataaattatgtcccccatttgctgcaactctcagtgttaagaatgattcagtgcagctataggagactacttccattggcatgccacctgcgtaaatacacaattttgttaagatatacaataaaattattatgctaatagcaaatattttatgtagctcactatgttccatgtagtcttctaagtgcttcatgttagtccccatttaaacacctggttttggaaggctgaggcaggaggattgcttgagcccaggagtttgagaccagccagagcaatatagtgagactctgtctctaaaaaaaaaaaaaaaaatttttttaaacacttagctgaggcatggtggtgcatgcctgtagtcccagctacattgggaggctgtggtaggagggttgtttgagcttggaatattgaggctgcagtgagcagtgatcaagccactgcactccagcctaggtagcagagggagactctgtctcataaataaatcatgttgtatagattcccatagaagtgagttagacatcaggcatagaattattagccgctttgatgtctgccttgggagtaaaacacataataaggggcagctttaaaccatctcaatcaatagcctctaacttctccagaaggttcttatttcatgaatttctaagcaagggactacctggattaagacatttggtagacaccattttgagatgaagaatcttgaatgggaagaagggagatctctacttactgaagcttcccgatgacatagttgagtgtcccccaaaaggaactttagaacaagatgttcatcatgccatatctctatggaaaaggaaattatttaaaagaaaacaaaggcaaacaattgataatctgattctcatgggaaagttttcattatcaaagaaaaagagggctgggttccatggctcacatctgtaatcccaacactttgggaggctgagaggggtggattacctgaggtcaggagttcaaaaacagcctggccaacccaacatggtgaaaccctgtctctactgaaaatacaaaaattagccaggcgtggtggtgtgcacctgtagtcccagctacttgccaggcagaggcaggagaatcacttgaacccaggaggtagaagttgcagtaagctgagatggcaccactgcactccagcctggatgacacagtgtgactccatctcaaaaaaagaaaaggacaaagtatattggtccaaaaaagaagaaagaatgaaaaaaaggacaaagtatactggttagtatcgtaacagtgagatagtccccctttgagattagaaaataacagtatactcaaagtaacatcaataagaaccaacataaaatagacaagattcactatctacaaaagtaatctgcaccaagtagcaatgtatgagcatgtggtggagaatattgtctataatatgtgtactagaaggaagagacctcaagaaaaaggtcagagctggaaatgtagattagggaatctaggtcaaagttttgagattttaggagtcctgagagaatttaaaaagcgaaatagccaccgggcgtggtggccacacccataatcccagcactttgggaggccaaggcaggcagatcatgaggtcaggagttcaagaccagtctgaccaacatagtgaaaccccgtctctactaagaatacaaaaaattagctgggtgtggtagcacatgcctgtaatcctagctacttgggaggctgaggcaggagaatcgcttgaatccaggaggtggaggttgtggtgagccgagatcatgccactgcactccaacctgggtgacagtgggagactccatctcaaaacaaaaaacaaaaacaaaacaaaaaaccagaaaaggatagggctgaagaacagaggttgctgcatttagaaaggaggcggggtcagaggaatagaaagggatagggctgaagaacagaggtcactgcatttagaaaggaagtggggtcagaggagcagagggagcatttggtcactgctctgctgagtaaagcaggataaagtccttcatgaccgttggacttttttattggaattattaaaaatcagatttcaatataaaaaacacaataattgatgaaaaaagatttctgaatgaaaccatgtgtcatagagtccaatggaaggggagaaacaggataatagaaaagccacaaaaagtagacgaaagttgtttttgtttattgtagaaaaaaataaactttatttaaagagaaatggttaagagaaagggaaaaactgaaacctgtgggtgaatacttagaatgacagtatttagctcagcctgaagacagatgaggatgaaaaatgtaatgggaactagataagagttttctaaaatttgtcttagtaagatgtaatttaagagaacttggaatatcttaaactgttaaaaacaatatttctagagcatctttaaaaactaaaatgtaaatataactactctttttttttttaactaacccttagtattttgtgtgtaaaaaccctcatttgtaacaaacattgttggcagtttaaatttcagaaaagataatgatgaaaatttgaatcatttttagcagttttaagaaaagtgactattattgaaatctgaccttattggcatcaggtttataaaatacactttatacacctgcataaatacgtattactaatccacttatgagaaataatatttttgagataaaagagggtctccagattttacaaaaataattttaaacactttttttaagcctaaaaaagaaaatgaagaattaagaaaactttttgagttaatatcatcactgaagtataatgtgaatcgaataagaaagaaaaatgatgaattagaagaagaggcaactgggtatggttttcatattgtagaacatgttagccatttattaattgatttaactctaattttacttgactaaaacctagatacaaattcattttatgtttgcattttcataattaaatgaattctgttttaaaatgtatttcagaaactcacagcacaactttttagacgtgtgtcatgggggtgggagtcagctgagctgctggggcaaggtgaaattttttttgaatgccaaaatattctttttttttttttttttttttttgagaaaaagtctggctttgtttcccagactggagtacaatggcgcggtcttggctcactgcaacctatgcctccaagcaattttcctgcctcagcctcctgagtagctggcattacaggcatgtgccaccacacccggctaatttttgtatttttattagagacggggttttgccaagttggtcaggctggtctcgaattcctgacctcgtgatctgcccgcttcggcctcccaaagtgacatgagccaccatgcccagccacttattctttaatgattttgaaaacaatgaccacgccttggacatataatgtccagtgcactcttcattatctggtttgaatttttatttctgaagatattttttgctgtctgtggtcattttttcttccttttgtagtatcctctgctgcattcaaattgtttaaagaagacctgtttgtgtcattctttaacatcaaatttatcttgatatgtagcttatattttgtttctgctttttcttttagatataaaacgtggaaatttactcattgtacatgagtacctctgttgtatacatgaagtatacatgttattaaacttgttttacataaataaatttcatatatataaaaatatacgtataacttaaagaaaaagtaaaatgaacattcatgttttgatcacagattttttttaaaacaatggaatctgtctttgaaaccctgaacacagctacttttctatttatttactgagcacttaatttggttttctgattagaatcaacatttttctgtcattgcttttctctacatggttttgtatctctttcattttgttgacattatgtcagcaaagatgtctagatctcttcttcaaagtctttaaatcgtcacacatctctctgcccctttccttttttctaaaactgcctgtatcctttttctcctcaactcagatattaaagatgttttcttctctttttctacattgaatgatctccttgatgctttttgtgtgtacttttttttcttctgatagactgtggtcagtgggtatcaaaatgtacttttgtgtctttttaaatgtatgtgttttacttttttatcttggttactcatctctgggttatggcttatatttagtaatacgttattttacttagcataccaacatggatatcagtagtttatttacaaaaagtgtatggttaggccaggtgtggtggctcacacctgtaatcccagcactttgggaggccaatgtgggtggatcatttgaggtcaagagttcaagaccagtctgaccagtgaaaccccgtctctactaaaaatacaaaatgagccaggcgtggtggtacacacctgtaatcccagccacttgggaggctgagacaggtgaatcacttgagtccaggaggcagaggttgcagtgagctgagaccacaccactgcactttggcctgggcaacaagagtgaaattccatctcaaaacaaaacaaaaaacaaaacaaaaacactgtatggctataatatcactttacctgccatatatgccataaaattgttcttcatattatttatctaagattataatttcatatagaatgctttcaaactatgttcagttgaaactgaaagtaacatagtttatagatttgtttctttgatatgccataacagatgtttaaacaattattaaatatttactcttaaaaatacttgacttactaattctgtacatttctgcagatataagaaactcctggaaatgacaataaatatgttaaatgtatttggaaatgaagactttgattgccatggagacttaaaaacagatcaactgaaaatggatattctgattaagaagctaaaacagaaggtaatttaaaaaaattattttatcttaaggtctagattacatgtgtgagacgtgcaggtttgttatataggtaaacgtgtgtcatgttggtttgctgcacctatcaatccatcacctagatattaagccctgcaggcattagctattgatcttgatgctctccctcctgatcctaataggccccagtgtttgttgttcccctccccgagtccatgtgttctcatcattcagctctcacttctaagtgagaagatgcagtgtttgtttttttcttcctgcattagtttgctgaagatatcagctttgagctcatccatatccctgcaaaaagcatgatctcattcatttttatggctccatagtattccatggtgtatatgtaccacattttctttatcccgtctatcactgatggacatctgggttgattccatggctttactgttgtgaatagtgctgcaatgaacatacaaatgcatgtatctttataatagaataatttatattccaacgtatggtaattttaaatcagttttggtattaaaaatcatgtaattttggaaaatattgataatggaaaaacccaaattctgccaaaatatgttgagaaaatagagggtaaatatatcttttcagactttgaatgcctcaggctcttagttaatcttccccagatctgggaagacctagaaggggagagattgggctacattaatgaggaccatttcaatctcttggccctgcagcagccatttcaaaatatgacaaaaaatatattttggggtaaaatattttgatttccttcagcttcttctctctgtgatgctgcaccagaatcaggttagaaaggaagccacattataagagttaataaaacccatctgatgagatttgatagtttgaagggtgtgattcccagaccctttagatagaaattggggccaaggaaaacaaggtcttattcctcaatataaatctgtcagtgctttaagcagtgaaagatttttcatttaattttacagacttgaaactaatgaaaaggatagcttttaaaatatcaatctctttttctatgaaaaggacatgctgttgattctcttaggccttgaaccctggccagtgatctgaaaccaagcagtacctgtctccagatcactactaccaaaatcactagtaccaaattaatttggggtggggggtaacaggtttattgagaaataatgaacacaccatgcaattcactcatttaaaatatacaatttattaacttcagtattttcagagagttatgcagtcatcattacaatcaattgtagaacattttcatcaccctaaaaacaaaccccacatcatttagctatcttcactagttttcccttcctccctcagccctaggtaaccacccaccttctttgtatagatttgcctataagcctctgaaatgaaaagcaagtggtctactgtgactggcttatttcacttagcataattttccatgctgcatctgtgctgcagcaggtattgatgcagggtttttgctccttagttcagctcaatctggtttcttctctcatgaccaggaaaaattaagcacacagacacattgaagggtgaggaggacagaatttattaagtgaaaggaaagctctcagcaaagaggggcgtcctgcaaacaggtttccacctcacaattgaataccaggagcacaggagctgaagcggccaggctcctgctctgcataaggcgtgaattcctggtgactccaccccatccccccagtgcttgtgggcctcgggtctgctgccggcatgtccaggcaagacaagtccaggttcccttatctgcacataacgtctggtgtaaacacttgtgaggcttgttggggattctccggggacccttccttatctgcctaggcattttgctgtctcctcctaatacagtatcagtacttagtttcttcttattgctgagtgatattccattgtatggatacatcaaacagtttatttatccattcaccaggtgatggacctttgggttctttcccacccaaaggtgatggacattttggttctttccacttttcactcttattaataatgctgctgtaaacatttacgtatgagtttttgtgcttgcatatgtttttgattttctggagtatatactcatgactggaatttctgggtcatatggtaacttcatgcttaaccttttgaggagctgccagtttgttttccaaagtggctgcaccactttacatccccagcagcattggataagggctttaatttctttacatttttcctaacacttattttctcttttttattgaataaaggtttcatcctgtggtgtgaagtgataccacacgtggttttgatttactttttcctaatgactaattacattaagcatctattaatgtgcttattatccatctttatatcttctttgcaaatatatctattcaaaatctttgcccattttttaaattgggttatcttgttatttatgaattgcaaaggttctttatatatcctacatatgtaagtcccttatcagatacatgcttttcaaatactttcttctactcagtatcttaccttttcacttcttgatactgtcttctcaagcacagcagttttcaattttgaagttcattgaatccatttttcctttggagtcatagctaagaaaacactgccaaatgcagtcacaaagatttatgccagggttttcttcgtactttatttattttttgcatgtggatatccagttgtcgcagcaccatttgttgaaaagactattcttttcccattctgttcttttgttaaccttgtataaaatcaattgactgtaaatgtgcaggtttatttgtagattatcaattcttagtttgtttatatctattcttatgccaaggccaaattgaatttaatgagaagattttttcaagcatgttgcatattaccagttgtcttatatcataataaaaattaaatttagtggaatatctttaacttcaccttttgtgcctcaaaggaatctctggccagcttataccttacttactctaagacatgatggcaagtcaggcttacaagacactctttctttttttctctattcaaacctttagtctcttttccattgcctccctctatagttatattttcagtaagttttcatcacaggatctgctgatgtagtctaatatttagtgtattatgttttgctaactcattataattcatagaatcttccatagatgtttaccatccaggaaggagaagtctgagctgccagctttcctcagtggaaatcatgtgaagtcatcatgttgtagttcgcagatcctctttccacctggtagctggttctcttgggtagctctgcatctaatcctttacttggtgcagatcttgcattctcagaaaccacagttccctgtattgacctccttttactgaaacagagatgcacagctctgctttctagctcagtagaggattcttgggatataaagtttaactcattccaagaaaaagtcttaggagtgcagcacttcaaaatcaggtaatgttcaggcaatttatcagagacaaatagtagattagtattttgacttttgaaatttcggagccaagttgtgtgctgtagagaagcattgtggtataatacagagatgggatggtcttaacttctccatacaaacaagcttgaagtaagataaaggagaaattgcatttgatgtcttaacactcaaagcatattgtgcttattttacttctgtgaagactaaaaatcattccataatgttctccttatttcctcattgagaaaaggaaaatgaaaattgaatactagattgattaataaatactcaaagcttattcttttagaattttcattaactgaaatcaggcaaatgtctgattttggttatctaaccaagtatttctagttgtttttcaaatcatacttcttctttctttgcagtcttatttcctaacttgaggggaaattgtaaggagacacccttgccttgttatcagagttcataattgaagggggttttaggaaatgttcctcctcagcagcttatgtctctctcctggttatctactgcttctcaataatgtttgccatcaataaattaatctcaacatttattagatcctactttaaaggagactcttttctctgcataagttatgtttcctgttgtctctttttaaaacttatttttctaacaattatccaggtttttgtggcttaaaagaaaaacatttattttgttcatgaacctatggtttgaaaaaagcttagccaggacaggtcatctctgctcccctcagcttccctaggaatagctgatcagttggggaaatggaatcctctgaagctttgctcacccatgtgtttgatggttgatgctggccattggctggaaccttggttggagcaggcagcatgaatattgacactgacactcccaggctgtctctctggcctgatctcactcacaatctgggggctgagttcaaagggaaagcagtctgagatagggaagccacatgatatcccttttactgcattctattcattagaaggaagtcagtaaggattgcccatattctgtttttttaatgggataaatatagcttctcttttgttttaattgacatgtatatacataattttggccaatagagtgatattttgatacatgtatatagtgtgtaatgatcgagctaactagcacatttactacttcaaccatttttcattttttgaattgtgaacattcaaaatcttctgcctttttaaaaatatacaataaatcatagttaaccatattcaccctacaatgccacagaacaccagaactcattcctcttatctaactgtaattcggtatccattaaccatcctcccctcccctacctctgtgagcttttttgttgttgttaagagacagggccttgctagtccagtctgggctctgggcatctgtagtcacccagactagagacagtggcttgatcatagctcactgcagcctcaaactcttgggctcatgtgatcctctgacctcaccctcctgagcagctaggattatgggcatgcaccattgcacctgtctgatttttgactttgtagagctatctacctatgttgtccagggtgctctggaactttggcctcaagtgattctcctgccttggtctttcaaagtgctaggaaattacaggcaatagccatgttgcccagccctcagtttttctttagctcccacatatgagtgagaatgtgcagtgtttatctttctgtgtctgcacttaacataccatccctcagactgatccacatggccacgaataacaggattgaattcctttatacggtgaatagtattctactgtgtttgtgtgccacagttttttgtccattcatttggttatggacatgcaggttgattccatacatcagctattgtgaatagtgctacaataaacatacgagtacaggtatctttttgatctattgttttcttttctattgcctgaatacccaatagtgggtttgccggatcccttggcagtcccattattagctttttgagaaaacctcatgttgttttctatagtggctgcactaatttaccttcccaccaacagcatgttagagtttactgttctctggaacctcaccagcatatgttatttttttgtcttttcaatgatagcaatttattcaaattgaagcaagattgtatcacattgaagatttgatttttatttccctgaggattagtgatactgagcgtttttaaatttatttattggctatttgtatttcttttttctaaagaaaagtatagttagatattttgcccaattttgaacccagatttttttttactgtcaagttttttgagtttcttgtatattttggatactagtcccttattagatgaatagttgacaatattttctcccattccactggttttctcttcactcagtttgctgggcagaagctctttatcttaatgtaataccatttgtctatcatttggtttttgcctatgcttctgatgtcttacccataaaaatctttgtgcagactaatgtcctcaagcatttttcctccatttacttagagtggtttcataattttaggccttaaatgtcagtcttcaatcaattctgagtttatttcattatgtgctgttacataggaagctagtatcattcttctccatatggatatttagttttcccagtgccattcatttgaagagactgtccttcccccagtgtatgttcttggcacctttgtccaaaatcagttggctgtaaatatgtggatttatttctgggtgtgtattctatggcctttaccccaagaatcattacttcgtaaaatgcaattcaaattagcatgaaacatttgcagtttaaggaaaggcttatggcatcagaatccttatttacaggattcattattttgtgtttttttgagatatggtctttgtctgtcatccaggcagaagtgcggtgatgtggtcataattcactgcagccctgaactctgggtacaagccatccttttgcctcagtctcccaactagctgggtctagaggcatgagccaccatgccaagctaatttaaaaaaaaaattttgtagacatgggggtctcactatgttgctctggctgatctcaaattctggcctcaagtgatcattctggcacaggcttttaaattgctacaattacaggaatgagccaccatgcctagtatagagtgttatattattttcaaagtcttattctgagagccatttattgactttggcctaaataactcaatatgatatctctgaaacttttttttgacatattatggggaatgataatgagggaaggtggttagacactttttactaagagataacttagtgccatctaaggaggaacaaaaatgaattatcagaaaaataaaagtaagatgaagtgcaaaagttctgtggcaaagatgatgatagcaaataatatatttttgtgactcatggtagctttaactttgttcttaaaattctgagtaatttaagggttcacatttgaagaatccactgcattacggataacattttattgcaagtaaatgcatttcaaaatttgctattggttttgtattagattattctcagcctacttcattatcaagctatattattttattcatgcagtttgatgatcttacggcagagaaggaagctttatcttcaaaatgtgtcaatttggctaaagacaatcaagttcttcaacaggagtttttatctatgaaaaaagtacaacagcaatgtgagaaacttgaggaggataaaaagatgttgaaagaagaaatattaaatcttaagacacatatggaaaacaatagggtagaacttagtaaactacaagaatataaattggagctagatgaaaaggcagtgcaggcagtagaaaaattagaagaaatccatttacaggttagttttttaaatcaggtaagtttatctgtaatgtgctttcatttatttcaccgcaaattatattttggatatgtatatattatgtttcctctgcctctcttgtagcaatttgctttgtagagttctagaaaaaaaatggcatctgttttttcttttaaatatttacatttccattattattataacaaaatcaatctttcagagtaatgattctcactgtggagtcatttgatgattaagatcagttggcataagaaacaattgtgatttcaaaattatgtgatacttttgaattggtcttaagctacattgttcattaatcactttttaaaattatgaatggattctattactttttatatgaccagattacattaatactaacataattatgatttcaaatttttataaatcagacaattctgaattcagttattagttttgatcttgctgataaatattttaagcttcagcctcttttactaacatattcacaattgctctttgaatcactgactcaaaatgaaaggcaacaaacatataataattaggttataattgttttaaaagtgtattcttttcctttgttttaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaagtaagtcaaaacatacactcatagaaaatgaattaagctcattaatttgttttgaaagcataatttttagtgagatggcttcaggagattagtaggaagtgaatgctaatctaataatgtaatttcagaaaataatgttagtaaataatcttacctttaaaatgttagtcaaggatagtttctgtcccatttctttctctctctctctctttttttttttgcttttgtatggcttttttcccctgaaaagtctcatgtagttaacctgatctgttagtttttgtcactaagtactttcgaagctttataattaataatgtgatcttgttataaaattgcttgtcagaattttcctaaatagaaatattaatgagtttaatttattttttggtagatcacaacctaaacccaaagtttcaagtggtactgctactccgggcacaatcatttttgattgtgatctttagtattatcactagagcgtgcctcaagaaagactatttgtgtaacattttcaagatgttacagaaaggcatccttgtgaaatagggaataattatcaaggaatttaaagaagtgtaattcacaaagtggttaaaacataactagaaataccatttgacccagcaatcccattactgggtgtatacccaaaggattataaaccatgctgctataaagacacatgcacacgtatgtttattgcagcactattcacaatagcaaagacttggaagcaacacaaatatccaacaatgatagactggattaaggaaatgtcgcacatatacaccatggaatactatgcagccataacaaataatgagttcatgtcctttgtagggacatggatggagctggaaaccatcattctcagcaaactatcgcaaggacaaaaaaccaaacactgtatgttctcactcataggtgggaattgaacaatgagaacacatggacacaggaaggggggaacatcacacaccggggcctgtcgtggggtggggggatgggggagggataacatttggagatatacctaatgttaaatgatgagttactgggtgcagcacaccaacatggcacaggtatacatatgtaactaacctgcacgttgtgcacatgtaccctaaaacttaaagtataaaaaaaaaaaaacttgttcagcctgaaggggtgtgtggaaggcagaaggaaaaagccccacctccagtgccttggtcacagtgctgggcgctaattgccttcagacatgctttagttctttttgatcaccaaccagccaatctagttctcccccaggagttgttgttctgaattattcctcagtgccaaatgcttaattgttcctagataatgggtgaaatgcacaagggtgaaacctaaaatttgtttgctaaacacaagtattcctaaatttttttgttgttgttcattttagttttcttaacctacattaaggagtacaacatgatgttttgatacaattatttctagtgaagtggttcttataatcaagcaaatcaacatattcttttctcacattgttaccctttaaatatgagtatttctaatggaatcttcagaatctcacaagtagagcccttttagaaggcagcaagtgttacctgtcaagccatatatcactgatagccatttctcttccctgtctactttgtttgtactgcttgttcagtataaatcaccttagaaacacaggtgcttctttagaatgattttaaaattatacttgcttacaacaggtatgctctcacacatcttcagtgtgaaaacactgtttagtggataatttggtttgctctcagggcaagtttttaaaaactgcaagtcattaagaatcattagaggaaaaatgaaatactaagcgtgtgtctttgctatctttacagatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcttagactgtggttagttacatgaccatttctcttttgggtttcatttctctaatataattcttgtttttaatttggtgaaatactgaattctgttgacttatgcatgttttgtaaagatcataattagctgtgttaacacagaaaggaaatgggaactttacattttttaattccctggagctctcattttcaagagatacccgtttactaactttattccataaatgtgactaaactgacacatttaaaatgtctttaaaagctgcatttaagttaggttttagaaattgcatattattgcctgataactgatgatatagtttgagatgctttggcttactctctaattgattatagtttagctgtggttcatactgcccccccttttttttaaattgagacagtgtttcactctattgcccaggctggagtgttgtggcaccatcttggctcactgcaacctccacctcccaggttcaagcgattttcctgcctcagcctcccaagtagctgagactacaggcacctgccattacacccagctaatgtttgtatttttagtagagacagggtttcaccatattggccaggctgttctcaaactcctgaccttgtgatctgcctgcctcagcctcccaaagtgctgggataacaggcatgagctaccacgtccagcccatgtcacttttaaagtttctttgcaccagccaggtgtggtggctcatgtctgtaatcccagcacttcgggaggctgaggcaggtgtgtcacaatgtcaggagttcaagaccagcctggccaagatggtgaaagtacaaaaagtagaaaaaaaaaattagccaggtgtggtggagagcacctgtaatcccagctactagggaggctgaggcagagaattgcttgaacccaggaggcggaggttgcagtgagccgagatcgtgccactgaactccagcctgagtgacagggtgagacttcatcttgaatataaaaaatttaaaaaaaagtttatttgcaccatctcaactcttcccacccataatcacaactgaatgattggcatccaaacagtttaccacatatagatgtttattatttagtagaatccaaaataattgcattttatgaattaaacaaaacactaaaatgttcatttccatttttatgttcaaagctttgtgcttggccaggtgccgtggctcacacttacaatcccaacattttgggaggccgaggcaggtggatcacctgaggtcaggagtttgagaccagcctggccaacatgatgaaacccatctctactaaaaatacaaaaattagcaaggcatgttggcaggcatgtgtaatctcagatacttgggaggctgaggcgggagagtcacttgaacccgggagacagaggttgcagtgaaccaagatcataccactgcactatatggagactctgtctcaaaaaaaaaaaaaaaaggtttgtgcttttcttacataagagtacatcctctgactataaaaatcctggaagaaaacctaggaaatactcttctggacttcatacttctcaattaatttatggcaaagtcctcaaaagcaattgcaagaataacaaaaattgacaagtatgatctaattaagctaaagagcgtctgcacagcatgagaaactatcacaggattaaacagacagcgtagagaatggaagaaaatattcacaaactatggatacagcaaacgcctattatccagaatccataagagatctaaacaaatcaacaagcaaaaaataaataacaccattaaaaatgggcaaaggacgtgaacagacacttctcaaaataacacatgtaagtggccaacaaacatattaacaaatgcttaccattgttaatcatcagaaaagtgccaaacaaaacatcagtgagatactatttcacaccagtcagaataacttttgttgaaaagtaaaaagaaaaaaaaaaagatgttggggaagcagtggagaaaagggaacacacaccgtttgtggcaatgtaaattaattcagctactatggagagcagtttggaaattaagaactaaggatgaccgttggatgcagcaatcccattactatactaggggtatacctaaaggacaataaatcattgtaataaaaagatgcttgcacatgtgtgttcattgcagcactattcaaagcagcaaagacatggagtcaatccaggtgcatccaaggcagattgaaaatccaaggtagattggaatgttccatacataccatggaatactatgcagccaagaaaagaacaaaatcatgtcctttgcagcaacatggatacagctggaatccactatcctaagcaaactaacacagaaacagaaaccaaatatctcatgttttcacttatgtgggagctacacattgggtgcacattgtcataaacctgggaacaatagacactgggaaataagaacagggagggacagagtgggccagggttggaaaactacttattgggtcctatgcttactacctgtgtgatgggttccactgtactctaaaccttggcatccctcaatattctcttggaagaagcctacacaggtaccaccttaatttagaatacaaactagaaaaaaacaaacaaaaaaaaaaacaagaaaaatttactattaaaaaagtttactataagtagagaatagaaatttctttttaagataaaatttattgatgtaaaaaaattggattaaacttgtataaagggcagagttttgctaagaatttcaaagcaatgcattcattgaaaagatgactttaattatttaatttttttttttttttgagacaaggtctcactgtatcaccaggctggagtgcagtggtgcaatcttggctcactgcaacctccacctcctggcttcaagcaattctcctgccttagcctcctgagtagctgggactacaagtgtgcaccaccatgcccagctaatttttgtatttttaatagagacagagtttccccatgttggccaggatggtctcgatctcctgacctcatgatctgcctgccttggcctccccaagtgctgggattacaggcatgagtcaccacacctggccattgtttaacctttgtactaataaaacactacctttctaaaatcatgtatatgcagtagaccaatattaactgtatttttgtctgattactctaaacagcattacacaggtgcatcctctgttatctaaacttaaaataagtagaaattttactttatttatgtgattatttttctatttaagcaaacttcaagttatgtctagtcactaaaaatactaaaggtcacattttgtaagtgatacattatttgcatgataatgtttcttgtttaacttaaacattattattatttttacttattttagatggagctggactgtgtagaacaaataactagagaaacaaagagaagtatgttgccaaaatttattaattacatttaggtttattttagaaattaagtgtaaataacaaatggcattccttttcattgtttggttagtagatactatgtcaagtattttttttcttacacacatctaatgcaagatgtgaaaacaaaaactttcacagagaagactgtacttatgcaccataaattcatcatgttccatagcttaaaaaattcccaagaagtctgtgcatctgttttttactggctctacactttcttaagttttgccatcatcatggaactgtcagccagcacactgaaacgattctcagaaaacaaaggcatcaccaagttctcagggttttggtacagattgaaggccaacagacctcagactcattttgaaattcttagctgggcaataacccttcataagcagtcacttgacaggtgacattttaaatctcctatcatatactgtgtcattggcttacatctgttctcaggaaaagttccaaatttttcaccatgaaataaaaacacccacgtcaatgtgattcttgtcaagttactcagccttgttttttgccacttaccgcactctaccctttgctctagcaccaaagtggaggagagtagaactccgcagggctcttcctcacctcaggctctttgccttcgcctcttccctctatctggcaagcttttccttgtccttcaggtatcaacctatgttatctcctccaccagaaagcccatgatattgacataaaagtgggatagatgtcccttttgtgtgttccagtagtgccctgctgtatacctgtcatggtatctatgacactatgtggacattgcctacctgtctgtgtttttaggttatagcatatgactattgggaggtggaccatgccatcttcatcttggaattccagtgctggttctagtaccttagcacgtggctgttgattacatgaatgaagaatgaaaaacctctaatatttaaacacaatagaattaatgccatgtgtaaattatttaatagtaattttgtattgtaaatgtacatagatatttctcattcttactaactctgataaagttctcaactctttagtatttaaactcacatttagttaactgaagtgttttaggtaaagaacataattctttctctttccagttgttgctgtgttgaacacttgctcccgtctacttacttctctataatccactggtaagccacatctaatgaagagaatgtttaaccataaagtcttaaggaaaaattttattatttaaaagattataaaactttattactgggctgtttacacaacattttaattgtttctcataaaatatataacattacaatctttactgaagtaggatgtttttgtatcacatgtgtgatgataatttatagggtaatttaaatgatgttttttagcctccttaagttttaagtggatcttgcaaatgaacaccagtattattgagtttgacgtactcaaattgcccaaatgccagctgtttaaacagccaaagaacgaagtcatcattgatactttagtaaaggtcatcgaaggcttctttgcattttacagcttttactacttaggggagttaaggagtacctgccaggcttgtgcatgctaatgtgacaattttctttttgtagttgaaccgtattttgtggggagatactttgaggctctgtaaatatccagttactcccagaacccactagatttagcatttcatggatgacttgtgtttgaacaattattactatgatggttgccagatgattattttcttctcttctttgctgtacctggagaagtaaaaccaataaataactgagaagggaaagctcatgattctggtgctccaattccccaagattaggccagtggtagacatttcaagctgacttcttgtcttttttatttgtcttcgttactctgtcagcacttttttagtttcaggaacaagatgttctaagctaatgttgtattttctctgctccagccatggaatgagtgatttttcttagaagcagaggtggagccactgaggaagcacaggcgagccctccccagcacgtgctcactggtccccaacagaacaaccgctgccgcatccatgaggtaccaagaaactagcaaagggccttctggctgtctgggcacagtcctcatgtggtccctggctcagcctcaagggtcctgcattagtcttcctgtagcctctgtgctgtgtctgtagatcgggactctgtgggaagggccctgggatgcccaacagcacaagatgtctcatctgccaaatgtccctgccttcctcccactctgacactcaggaataggctacatggcatgtccaggcagtgccaggccacctcactatctcctttgagattggcccagagggcttttggggtgagtgtggagctgggcacctggagcctgaggccagctgtctctccctctgtcttggaggaaaagccatgtcccaaaaaaaaccccagggcctgacctctggacacacatacagggagggagggtctgtgggctgaggggggcattgtaatgagactttgagcacgctgctcaggggcctggtcagtggaccatgctcagagatgacctggtcattaggacctagtcagttgggacctggttagtggtggcctcctcagtaaaggcctcctcagtggggacctggtgacctagtcattggaagcccggttcatggggacctggtcactgatggtcttcttagtgaggcctgatgggctggaacataaacaatgaaaaactggtggggcctatgcagtatactaggggcctggtcagtgtggggccttagtggcttggagcctcgtcagtgagggtctggtcagagggggctcggtcagctggggactgatccatggaaaattgtttagtgggggtcaggtgagcagcgacctggtcaactgtggtcttgtcagtgggaacctggtcagtggggaccaggtcagtgggaaattggtcagtgaggtctggcctatgaggcctattaagtgtgagcctggttaggaagacatggtcagtggggacttggtcagtgggaactggtaaatggaggagtggtcattagaggcctcatcagtgggaaactggtcctgggcggctggtcagtaggaacctggccagctggccactgtgtgacctcaggcagggggtttgtctgtggagtctccttgcctccatctgcagggaaggtgagtcagggcaccttggagggtggctggaaagagaaggtgagaagatgtgttgaatccagcaccacttggcagacctacaactttacacatgacctgtgtgccacctagagggggtcccagccctctctgctgtgcctggtgcccctcctctctctgcatccccaggaccaccatgggtggggaaggcagagattggggagcacctgtagaagctctaatgctggccatgagccctcggtgatgacctgggtgcacctgtgagtggagaagctaggcctggccagagaagcaagagaaacacacacacacatatgtgcacacacacacacaggcacacacgcatgcacaaacacactgcatccacacatgtcagttcaggggatagaggacactgactctgggcgctgttgacccatgcaggctcccattgtggtgggttgtgtcaccccacaatgtcactgttgctgagcccccatcgcctctgtgttgtggagcagttagagacacactgtggtgtctgagtggctctgcgtgaaggaccgttttctaggtgagaggcacatctcaacacagctgactgatcagactcaggtgagtgggacctgctctcttctcttgctcctagcttggggacagtcgctatcagttgggtggttttggcctctgagcagctactgagggtaatccctgaacactcaccggatgcctattctgtgctgacagtcatctcgttcatcctcgcagcaattccattctgcatcttttctgatcacccccgtgattacccaggacaaccccatcaggccctctcacccaggcccagtccagctccatgataacaaagacgcaggtccagagacaactgccctgcatggtgcctgcatctgaccccccttggtgggtagtgaccagcacgacatggaagaagccagggcagcatgcagccagctgccctgcagccccagatggctcctaggccttgggaagtcattctcaaaggggaagctggtcattttgaggtccctggagggaagggtgaatgtgtcatcccaacagccctggaagccagcagcatgccatacatcttacccaacctgtgtgacagaggccccctcctggggcacaagtcccatacctaaagggtcctgtcctagttgaacctcatcctgagccctgggaggggaggagcaccatgggcctccctgcagcagccaggattaccacccaggggactcagccttctgtggccctggccagagttagaatttggcccaagacaagacaagctcactcggagcagcttgtcagtacccggggcctgtgcatgccaagtaagtccaagctggctcaaagagcaaccagccacctctgcaagggtgtgccaggagcaggtggaccagccaccaacctcacccactcaaggaaacagggatggccaggttcccacaccctgagtgaccaccacctgacagctgatgaagtggaggcctgaggaaaagcagatggcactggggccctacctccagggcagaataactgatttaccccgattggcagcaagtgaggttggtggctggtccacctgctcctggtacacccttgcagaggtggctggttgctctttgagccaacttggccttgcctggcatgcacaagcctcagttcaacaactgtgctgcaaatggagccacatagaggaaatgagcagcagcctcaggagcagggtttgcgctgcctttggggctccaatccatgcatcagggctcctacagcactgtgggcttcttgggtgccaagaggcagaccacaggccctcttgaggaggattctatgttcaagtgcagaaagggcccaatctggtggatgaaccacatggccagcttctgggtgcaggcacagtgccacatcttccatcacttcctgatgtgccacaccagcactgaagagacagcctggagacagggcaagaggaaggctgagaaggatgagatggtgagtgccagattctccctggctctgagcccacctccagggtgacactcaaactttaggagtgggagagcaagattgacagcttcaaatgcttcaccaagaagatgaacaacagggcactcggctcaacttcacagccaatgagttgacatgcaagcaggtgatggtgacaggctttaagaaggagcatcagaaggctgccagttcttcagcctcagccaggccttggagctggaccagcccatccacttcaccacagatgccttcaacactgtcagtgagctctttgccaatcatcccaggcagaacctggacccagtcatggacctgttagtgctgtctcagggacaccagaccaacatcctgaacatcatccacatacacaagcaagttcttaccaaagtcgcggaggacaggcaacatgtggcagaagggaagatagagatgcagaggctgatgacaccagaatcacaggaacaggaattctttcaccacttcagtggaaattcaccacttccatccaatttgaatgagagacatgaaatcacagatgcagcatttcttgcaacaagagatactattttttcaaaaatcatccaggaattgataatgttgaatgactagatatttgattgtggactgtttccagttcaaggatactttctacacagaataataacactagcaaggagctagtgccagctatccgtggtagcacaaggatggttttgtgctcaactgaaatccagctgaatacagaattgtgtaggaaacagttaatatgttgacagaatagaaacagtagcaaacatgaactaaatcatgccatgaatgcctaaactaccattgggacttttggaagaatgataataccactttactgctctttgaagtatgaatattttagtgtatatgctgtagaccacaaaccctataaagagtcccaaataagttggctggataaagcctgctgtgcatgtctttatactcaaagactgatgatgcaattcgaatatgtgtccccaccaaatctcatatttaattatatttcctaatgtggaaggtggatcctggtataaggcaattgatttatgaaggcaaatttctcatgaatggttcagcaccatccccttgtaccatcctcacaatcatgagtgacttctcgtgagatctggccactgaaaactatgtcacctccctactctgcgtgttttcctcttgccatgtgagacaactcactctttctttgccttgtacaaagattgaaagatttctgaggcctcccagaatcagaagccctgtgcttcctgtccaccctgcagaaccatgagccaattaaacctctttttcaaaatgaatcaaacagaaaatggcaaatgacgattgcagcattgctataaagatacctgaaaatgtggaagcagctttggaactaggtaatgggcagaggttggaagagtttggaagtctcaaaagaagacagatgagaaaatttttggactatcttagagactggttaaatggttgtgataaaaatcctggcacaaacatggatagtgaaggccaggctgaggaggtctcagatagaaataagaagctttctggaaaaggtcttccttttgaatatggaaagcttacacaatgcctgtaccatcattatacgttagaagctgtgagcttgctttttaattcagaggctcataggaaaaagagaccgtagccttgactcagatgagattttggactttgtaagtttgagttaatgctgaaatgagttaagactcattctggcaaggcatgattgtattttgcaatgtgagaaggacatgatattcatgggatcagggacagaataatatggtttgtctctgtgtccgtatcaaaacccatgtggaattatactccctaatgttagaggtggggcctaggtggaaaaagatttagttataaaagggtgcgggtaggttctccacgaatgataaaggaccatcaccttgatgctgtcctcctgatagcgagtgagttctcatgagatctggttgtttaaaaggctgtggaacctctttcctcactctgtcttcctcctactcctgccttaggaggtatctcattgtcttggcttttggtataattaggaggcttcttgattcctcccagaaacggaagacactatgcttccttcacagcttgcaaaaccatgattcaattaaacctctttcatttacaataatagagaaaattagaactgccgagagagctgtgcatgtcttcaaggccttttttccctttgtcttggctattagcacagggcttctttatatgcaaatttctgaagtcttcttgaatttttccccttaaatggggttttgtgttattgctacatagccaacctgctatagagatacctgaaaaagtagaagcaggctcagtagtgggtagcaaacaaagattgggagggtttggagggattagagcatgacagaaagatgagggagagggaggaagtgatttaatcatggatgggcaggggtgggtgtggatggaaaaaggggtgggtagggtgggaatgagtaggctggctgtagggtggtgggagggtcgtgggtagtaggaagggggagtagcgtgctgcagaggcagagcctcatgtaaaaccattactagggcagtgcacctgtggctttgcaggtttgagcccccatggatgctctcatggactggactagtgttcagtgcctgtagcttttccacactgagggtgtaagctgttggtgggtctctaaatctggggtctgtagggtggtagccctgtgtgggggctccaagtccgtattttccttctgcactgccctagtagaggtttcccaagaactctgcgtctgcagcaggctgctgcctggaaacagtgggaggtgggggtgggaggcagatccttcaccaatggttaagcaacatcttcttgatgctgacctagtaacagtgagttcttatgagatctggttatataacaaggtgtggcacctctttcctctctcagtcttgcttctattccagccatatgaaacatctccttgccccttggccttctggtatggttgtgaggctccctgagacgtcccagaagcagaagccactctgcctcctttacagcctgctgaaccatgagccaattaaacctcttttctttatgatcatacagaaaattagtgctatgaagtggagctatgaagtgccttcaaggccctttccccttttcttggcaaccagcactcagcttcttttcatgcaaatatctggagccttcatgaattttgcccctgaaagtggacatttcttcttttaccacacggccaggttgtgataaagatagctgacaatgtagaaccaggttcagaagtgggtaaaagacagaggtcaggagagttgggaaagcttggaagacagcaagatgaggaaaatttgaccactgtagagaattgttaaatacttgcgatcagaaggctgacagaaggataaacactgaagtccagacttaaaaggtctcagatgaagattaggaatttcctgtgaacaggagccatggttacatttgattggccttagcaaagaacgtggctgcacggtgaccctgccctggacatctatgaaactatgaatttgggggtgatgatttaggatgtatctggtggaatgaacatctaggcagcctagcgaggtgtcctgtctgcattgaatagcctgtgttcttatgcgtgacctaagaaatgacttcaagttggaacttctattgaaatgagaagtggagacctaaagtttggaaaatctgcagcctggccaagtggtcaaaaagaaaagctgattttccgggggaaaattcaaggaggcttagagtatctgcataaaaagaagcccagtgcaaatagccaagacaatgggaaagaggcctcgaaggcatttcacagtcctctgcagcagcccttgctgtcacaggcccccatacagggaggcatcattctccaaaccccagattcatagacccacaaacagcttgcaccctcagtatggaaaagctacaggcactcaacaccagccctgtccatgacggcagctacaggggctgaacactgcaaagccataggtgcagatctgcccaaggcctaggaagaccagccctcatacccctgtgccatggatgtgggacagggattcaaaaaggatgattctggagctgtaggattgagtgactggcctgctgggttttggacatttatgtatcctatgaatcccatctgtgttttgtgcttctttccagcaatttttttttctattggttgagaatgcttacccattgcctgtacaatcattgtagcttggaagtagttaagttgttttataattcacagactcatggcagaagggactgtagacttgtctcagataagactttgggctttggatatttgagtaaatgctgtaatgagttaagatttgggggactgtagggaaggcatcattgtattttgcaatgtgagaaagacatgagatttgggggacccgggacagagtaatatgatttggctctgtacctctcccaaaactcatgtggaattttaatggggaatgttaaaggtgggggctgctggaaggtgatttaatcatggtggagagtggaggttggatgggagggatggggagagttggagggtattgagggggtggggagagttgggggggattgtgtttgggtttatgggtaaaaggcaggagtgggggtggatccttcacaaatgggtaaacaccatctccttaatgctgcccttctgagagtgagttctattcatgattttggagctgtgagattgaatgaacagtgtcctgctgggttttggatgtgcattgggcctgtggtcccacttgtgttatttttcttggaaatttcttccctttggattgagaaaacttacccaatacctgtaccatcattgtacctagaaagaaatgaatgcccttttaacttcagggcctcataggcagaagagactgtagcctgatctcagatgagacttttaacttttcacatttgagttagtgtggaaatgagttaaggcttttggaaacttttgaaaagatgtgattgtattttactgtgtgagaaggacatgggatttgggggggtcaaggtcagcataatatgatttggctgtgtgcctctagaaaaactcacatggaattgtaatcccaaatgttggaggtggggcctggtgggagattatttaatcatggatgggaggtgtgggggtggaagaaaaaaggggtgggtagggtggggaacagtatgctggctgtagggtggtcggagggtggtgggtagtaggaagggggagtagcctgctgcagaggtagaggctcatggaaaacctctaccagggcagtgcacctgtggctttgcaggctttagcccccatggctgcccttatgggctgggctggtattgagtgtctatcacttttccaaactgagggtgtgaactgttggtaggtctacgaatctggggtctagaggatggcggcttcctgcagagcgactcaaagcccttgttttccttctgcactgccacagaacaggatttccaagaggctctgcctctgcagcaggcttctgtctggaaacagtagggggtggaggtgtgttggggggtggatccttcaccaatggttaagcaccatcttcttgatgctgacttagtgatagtgagttctcatgagatctggttgtataacaggctgtggcacctctttcctctgtgagtcttgctcctactcctgccgtatgaaacatttcattgctgctttccttctggtatgattgggaggcttcctgagtcttcccagaagcagaagccaccatgctttctttacagcctgaagacccatgagccaatgaatccccttttcattatgaccacacagaaaataagtactgcaaagtggagctatgaaatatcttcaaggacttttccccattgtcttggctgttagcactgggcttctttttaatgcaaatatctgaagccttcttgaagtttcccctggtggagagtggaggttggatgtgtgggaaggggacagttggagggtattgggagggtggggagagttaggggggattgtgtttggggttacaggtgaaaggcaggagtgccaggctgcaacaaagatagctgaaaatgtaaagcggttcagaagtcggtaacaccagaagttggagagtttggagagcttgaaaaaagacaggaagatgagggaaagttgggaccattgtagagacttgttaaatagttttgattagaatgctgacagaaggaaggccagggaaggccaggcttacaaggtctcagatgaaaatgaggaacttactgggaacaggagccatggttacttttgttttgctgtagcaaagaacgtggctgcagggcgaccttgcccttgagatctgtgaaactttgaacttgagggtgatgatttagtgcatatctggtgaaatgaacttctaggcaccatagcacaagagggatcctgtctgcatcaaacagtctgtgctgttatgtgtgaccaaggaaatgacctcaagttggaacttatatttaaatgataagcagaactcaaaagtttgaaacatttgcagcctggccagatggtcaaagagaaaagctgattttcagggggaaaattcatgaagtctccagaaatttgcataaagtggaggccagtgctaatagccaagacaattgtggggaaaaggcttggaggcatttcagagatgtttgcagcagcccttgctgtcacgggccttgggacctaggagagaagaatggtttcctgggccagccccatggccctgctgctgtgtgtagcctcaggacactgctgcctgcatcccagcagccccagctcctgctccgaccttggctgaaagatgtacaggtacagcttgggtcactgcctcagagggtgcaagctataggccttggttgcttctacatagtgttaagccagtgggtgcacggagcactagtctagagacttgggagcctccatatatatttcagaagatgtatgaaaatgcctggtgtccagacagaaggctgccaaaaaagcagagtctcatgggaaacctctacttgggcagtgcagaaggaaaatatgaggttggagcccccacactggaggccaccatcgtgcagaccccagattcatagacccatcaaaagcttcgtaccctccatgggttaaaaactccaggcactcaacaccagcacagcccatgagggcagctgcgggggctgaacactgcaaagccacaggtgcagagctgcccaaggccttgggagcccaccctcatgcccttgtgccctggatgtgggacaaggatttaaaaaggatgactttggagctgtaggtttgaataagtggcctgctgagtttcagaattttgtgggacttgtaagtcctgtttgtgttttgttcttctctctggcaaaaatcttccttttgggtggagattcttactaaatgcctggacaatcgtaccttggaagtggttaacctgctttgtatttcagaggctcaggggcagaagagactgcagctttgtctcagttgagactttgggcttcagacatttgagtaaatgctggaatgagttaagaccttgggggtcttatccaagacgatggggaaaagtcactgaaggcatttcatagcttaacttcacagtactaattttttgtgtgttcataacaaaaaggggtttaattggcttatagttctgcaggctgtaaaaaaagcatagtggcttggggaaatggcaggtaatgcatcatttcattttgcaaagtgagaaggacatgaaatctgggtaggcagggacagaatgataagatttggctgtgtgttacagaaacttatctggaattttaattggaaatcttaaaagtggggccaagttgaaggtgatttaatcatggagggcagtgggtgttggaaggtggggattggggagaatgggtggattttggtggaggtgaggggtgaaaggtagggttggaggcaggatccctcacaaatggttaaacactgtctccttaatgttttcctcacgatggtgagttctcgtgatggttttggagctgtgagattgaatggatactggccttctgggttttggacttgtgttggccctgtcatctcatttgtgttattttcctggcaatctcaaaccctttggattgagaaaacttgcccaatgcctctaccatcatcataccttgaaagaaaagaactcccttttaaattcagggactcataggcaaaagggactgtagccttttctcaggtgagacgttgaactttttacatttgagttaatgttgaaatgacttaagactttcagcaacttttgaaaaggcgtgattgtattttactctgtgagaaggatatgatattcaggggatcagggtcagaataatatggtttagctgtgtatccctacctaaactcatgtggaattgtaatcctgaatgttgcaggtggggcctggtgggaggtgatttattcatggatgggagaggggtggggttggaagtacaaagaggtgggttaggtggggaggagtaggttggctgtagggtggtgtgagggtggcatgttgtgggaggggagtagcctgctgcagaggcagaggctcatgggaaacctctactagggcagtgcacctgtggctttagcccccatggctgctctcatgggctaggctggtgtttagtgtgtgtagcttttccatactgagcgtgcgggctgttggtgcatctatgaatctggggtctggaggatggtggcctcctgcataggggctccaaacccatattttccttctgcgctgccctagtagaggttttccaagaggctctgcctctgtctcaggcttctgcatggagacagtgaggggtggatatggggtggggggcagatccttcaccaatagttaagcatcgtctttgtgatgctgatctcctcatagtgagctctcatgagatcaagttgcataacaggatatggcacctctttcctctcgctgtcgtgcttctgctcctgctatatgaaacacttcattgccgcttggccttctggtatggttgtgaggcttcctgagtcctcctagaagcagaaacaactatgctttctttacagcccgaagaactgtgagtcaattaaacctcttttctttatgtatatacagaaaatcaatgctgcaaggtgaagatatgaaatgccttctaggcctttcccgcaatctcttggctgttagcactgttttttttaatgcaaatattggaggccttcttgatttttcccttgataatggacccttcttcttttaccacattgccaggctgtgacacagatagctgacaatgtagaagccagttctgaattgggtaatggccagaggttagagagtctggaggatggtaacctcttgtgtggggccaccaagcctttttttttgttttttgttttttttctgctttgtcctagtagaggttttcctagtagctctgcctctgcctcaggcttctgcttggaaacagtgggggttgtgggtggtagggggcagatctttcaccaatggctccaccaatggttaagcattcttgatgctgaccttgtgttagagagttctcaggaaatctggttgtataacagggtgtggcacctttttcctctctctgtcttgtttctacttctgccatataaaacatactattggtgcttggtcttctggaatgattgggaggcttcctgagtcctcccagatgcagtagcctctatgatttatttaaagcgtgcagaaccatgagccagttcaacctcttttctttctgattatacagaaaattagtgctgtgaaatggagctatgaaatgccttcaaggccttttccttattttcttggcaatgagcactcagcttcttttccggcaaatatctgaagcctgcctgaatttttctcctgaaacagactttgcttcttttaccacattgccaggctgcaacaaacatagctgaaaatgtagaagcaggttgagaagtgtgtaacggccagaggttggagagtttggaggtgttggaagaagacaggaagatgtggaaaagtttggaccagtgtagagacttgttaaatagttataattaaaaagatgacagaatgatggacagtgatggccaggcttagaaggtctcacatgaaaatgaggagcttgctgggatgaggagccaaggtcacttttgttttcccttagcaaagaacgttactgcacgatgccgttaacctggagatctgtgaaactttgaacttgagagtgatgatttagagtgtatctggtggaatgaacttttaggcagcaaagctcaagaggtgtctggtctgtgccaaacaccctgaggtgtcttatatgtgaccaaagaaatgacctcaaggtgaaacttatatttaaatgagacggagagcttaaaagtttggaaaatttgcaggctggccaagtggtcaaaaagaaaagctgattttccgtgggaaagttcaagaagatttcagaaatgtgcataaaatggaattgagtgctaatagccaagacaaggataaaaaggccttgaaggcacttcagagacttttgcagcaacccttgctgtcacaggcccccaggcctgggagaaaagaatgatttccttatccagtcccatggccctgctgctgtgtccatcctcaggacactgctggctgcatacctgaagctccagctccaaccatggctgacagatacaaaggtacatcttgggtcgctgcttcagagggtgcaagctgcaagccttggtggcttccacatagtgttgagccagcaggtgcaaaaaggccaagactagaggctcagaatccttcatgtagactacagaggatttacagaaaaacctgggtgtccaggtcgaaactattcaaagaggcagagcctcatgggaatcctttactagggcagtatggaaggaacatatagggttggaaccaccacacagggagcaccattctgaaacgtcagattcatagactcactaacatcttgcatcttcattgtggaaaagctacaggtgctcaacactagcccagcccatgagggcagctgcgggggctgaacactgcaaagccacaggtacagagctgcccaaggccttgggagcccagccctcacgcccttgtgtcctagatgtgggacaaggacttaaaaaggatgattttggagctgtaggtttgaataactggcctgctgggttttggaatgtcatgggaacctgtaagtcccgtttgtgttttgttcttctctctggcaaaaaatcttcctttcgggtggaggttcttactcaatgcctggacagtcataccttggaggtaattaacttgctttgtatttcagaggctcaggggcagaagggatggcagtcttgtctcagaagagactttgggctttggacatttcagtaaatgctggaatgagctaagacattgggaaactgtagagtaggcatcattgtattttgcagtgtgagaacaacatgagatatggggggtcagggtcagaataatacgatttgggtctgcatccctaccaaactcatttggaattgtaatggtgaatgttaaacgtggggcctggtgtgaggtgatttattcatggagaagagtgggcgttggaggtaggggtgtggggagaatgggggagattattttgtgggtgggggtaaaaggtaagggtaggggggcagatccttcacaaatgtttaaacactatctccttaatgccgcctgcgtgatagtgagttctcttgatgatatttgcagctgtgggattgagtgaatactgtcccgctgagttttggacttgtgttgggcctgtgggcccatttgtgctatttttatgggaaatttcttccctttggactgagaaagcttacccaatgcccataccatcattgtacctggaaagaaaagaactccattttaaattcagggactcataggcagaagagactgtagccttgtctcaggagagactttgaacttttttacatttggaatgagttaagacttttggagatttttgaaaagtcatgattgcattttgctctgtgataaggacatgagattctgggatatcagggtcagaataatatggtttggctgtgtgtccctatgaatctcatgcggaatcgtaatccctaatgttgaagcgggtgacttaattatggacgggaggttggtggtggtggaaggtaaaagggatgggtaggattgggaggagtgggtcggtagtagagtggtgggagggtgggtggtagtaggaaggaggagcagcctgctgcagagtgagggactcacggaaaaccctctactagggcagtgcacctgtggtttgcagggtttagctcctcagctgttctcatgcgcgggactggtattgagggcctgtagcttttcctcactgagggtgccagctgttggtgggtctgtgaatctggggtctggacggtggtagccccctatgtgggggctccaagtccatattttccttctgcactgccctagtagaggtttcccaagaactctgcatctgcagcaggctgctgcctggaaacagtgggaggtgggtgtgggaggcagtcccttcaccaatggttaggcagcatgtgcttgatgctgtcttcatgatagtgcgttctcatgagatctggttatataacagggtgtggcaccgctttcctctctcagtcttgcttctactcctgccatttgaaatgtctccttgccccttggcattctggtagctatgaagtgccttcaaggccctttccccttttcttggcaaccagcactcagcttcttttcatgcaactatctggagccttcatgaattttccccctgaaagtggacttttcttcttttaccacactaccaggttgtgataaagatagctgacaatgtagaaccaggttcagaagtgggtaaaagacagaggtcaggagagttgggaaagcttggaagacagcaagatgaggaaaatttgaccgctgtggagaactgttaaattcttgcgatcagaaggctgacagaaggataaacactgaagtccagacttaaagggtctcagatgaaaattaggaatttcctgtgaacaggagccatggttacatttgattggccttagcagagaacgtggctgcacggggaccctgccctggacatctatgaaactatgaatttgggggtgatgatttcggatgtacctggtggaatgaacatctaggcagcctagcgaggtgtcctgtctgcattgaatagcctgtgttcttatgcgtgacctaagaaatgacttcaagttggaacttctattgaaatgagaagtggagacctaaagtttggaaaatctgcagcctggccaagtggtcaaaaagaaaagctggttttccgggggaaaattgaagaaggcttagagtatctgcataaaaagaagcccagtgcaaatagccaagacaatgggaaagaggcctcgaaggcatttcatggtcctctgcagcagcccttgctgtcacaggccctagggcctgacagagaagaatggtttcctgggcaagctccatggccccattgctgtgtgcatcctcaggacactgctggctgcatccctgtagttccagctccagccatggctcaaagatgcacaggtacagcttgggttactgcttcagaggtggctccaagccttgattgtttccatatagtgttaagccagcaggtgtacagagtaagagactagaggcttgggagcctctgtgtagactccagaagatgcacagaaaagcctggatgtctaggaaagaagcttttccaagaggcagggcctcctgggaaacctctactaggggagcaaacaagggacatatagggttgaagcccccacacagggaggcatcattctccaaaccccagattcatagacccacaagcagcttgcaccctcagtatggaaaagctacgaggcacacaacaccagctgtgtccatgagggccgctgcaggggctgaaccctgcaaagccacaggtgcagattggcccaagaccttgggagcccagccctcacacccctgtaccatggatgtgggacagggattcaaaaaggatgattctggagctgtaggattgactgactggcctgctgggttttggacattcatgtatcctatgaatcccgtctgtgttttgtgcttctttctagcagtttttttttttttttcttttggctgagaaggcttacccattgcctgtacaatcattataccttggaagtagtgaagttgccttataatccaaagactcatgggcagaagggactgtagacttgtctcagataagacttcgggctttggacacctgagtaaatgctggaatgagttaagatttgggggactgcagggaaggcatcattgtattttgcaatgtgagaaagacatgagatttgggggaccagggacagaataatatgatttggctctgtgcctcccccaaaacttgtggaattttaatggggaatgttaaaggtgggggctggtggaaggtgatttaatcatggtggagagtggatgttggatgggggggatggggagagttggagggtattggagggtggggagagttggggggtttttcgggggatggggagagttgggattgtggtggggttatgggtgaaaggcaggtgtggaggtggatccttcagaaatggttaaacacagtctccttaatgctgtccttctgatagtgagttctcttcataattttggagccgtgagactgaatgaacactgacctgctgggttttggatgtccattgtgcctgtggtcccacttgtgttatttttcttggaaatttcttccgtttggattgagaaaacttacccaatacctgtaccatcattgttccttgaaagaaaggagtgtgcttttaatttcagggactcataggcagaagggccttgtctcagatgagacttttaacttttcacacttgagttaatgcgggaatgagttaaggcttttggaaacttttgaacaggtgtgattgtattttactgtgtgagaaggacatgggatttgggggggtcaaggtcagcataatatgatttggttgtgtgcctctagaaaaactcacttggaattgtaatcccaaatgttggaggtggggcctggtgggagattatttaatcatggatgggaggtgtgggggtggaagaaaaaaggggtgggtagggtggggaacagtatgctggctgtagggtggtcggagggtggtgggtagtaggaagggggagtagcctgctgcagaggcagaggctcatggaaaacctctaccagggcagtgcacctgtggctttgcaggctttagcccccatggctgcccttatgggctgggctggtattgagtgcctatggcttttccatactgagggtgtgaactgttggtaggtctatgaatctggggtctagaggagggcggcctcctgcagagcaactcaaagcccttgttttccttctgcactgccacagaacaggatttccaagaggctctgcctctgcagcaggcttctgtctggaaacagtagggggtggaggtgtgttggggggtggatccttcaccaatggttaagcaccatcttcttgatgctgacttagtgatagtgagttctcatgagatctggttgtataacaggctgtggcacctctttcctctgtgagtcttgctcctgctcctgccgtatgaaacatttcattgctgctttccttctggtatgattgggaggcttcctgagtcttcccagaagcagaagccaccatgctttctttacagcctgaagacccatgagccaatgaatccccttttcattatgaccacacagaaaataagtactgcaaagtggagctatgaaatatcttcaatgacttttccccactgttttggctgttagcactgggcttctttttaacgcaaatatctgaagccttcttgaagtttcccctggtggagactggaggttggatgggggggaggatggggagagttggagggtattgggggggtggggagagttgtgggggattgggattgtgtttggggttacgggtgaaaggcaggagcgccaggctgcaacaaagatagctgaaaatgtaaagcaggttcagaagtgggtaacagccagaagttggagagtttggagagcttgaaaaaagacaggaagatgagggaaagttgggaccattgtagagacttgttaaatagttttgattaaaatgctgacagaaggaaggccagggaaggccaggcttacaaggtctcagatgaaaatgaggaacttaactgggaacaggagccatggttacttttgttttgctgtagcaaagaacgtggctgcagggcgaccttgcccttgagatctgtgaaactttgaacttgagggtgatgatttagtgcatatctggtggaataaacttctaggcaccatagcacaagagggatcctgtctgcatcaaacagcctgcgctctcatgtgtgaccaaggaaatgacctcaagttggaacttatatttaaatgacaagcagagctcaaaagtttggaacatttgcagcctggccaagttgtcaaagagaaaagctgattttcagggggaaaattcatgaagtctccagaaatttgcataaagtggaggccagtgctaatagccaagacaattgtggggaaaagccttggaggcatttcagagatgtttgcagcagcccttgctgtcacaggccctgggacctaggagagaagaatggtttgctgggccagccccgtggccctgctgctgtgtgcagcctcaggacactgctgcctgcatcccagcagccccagctcctgctccgaccttggctgaaagatgcacaggtacagcttgggtcactgcttcagagggtgcaagctataggccttggtggcttctacatagtgttaagccagtgggtgcacggagcactagtctagagacttgggagcctccatataaatatatttcggaagatgtatggaaatgcctggtgtccagacagaaggctgccaaaaaagcagagtctcatgggaaacctctacttgggcagtgcagaaggaaaatatgaggttggagcccccacactggaggccaccatcgtgccaaccccaggttcatagacccatcaaaagcttcgtaccctccatgggttaaaaactccaggcactcaacagcagcacagcccatgagggcagctgcgggggctgaacactgcaaagccacaggtgcagagctgcccaaggccttgggagcccagccctcatgcccttgtgtcctagatgtgggacaaggatttaaaaagaatgattttggagctgtaggtttgaataactggcctgctgggttttggaatgtcatgggaacctgtaagtcccgtttgtgttttgttcttctctctggcaaaaaatcttcctttcgggtggaggttcttactcaatgcctggacagtcataccttggaggtaattaacttgctttgtatttcagaggctcaggggcagaagggatggcagtcttgtctcagaagagactttgggctttggacatttcagtaaatgctggaatgagctaagacattgggaaactgtagagtaggcatcattgtattttgcagtgtgagaacaacatgagatatggggggtcagggtcagaataatacgatttgggtctgcatccctaccaaactcatttggaattgtaatggtgaatgttaaacgtggggcctggtgtgaggtgatttattcatggagaagagtgggcgttggaggtaggggtgtggggagaatgggggagattattttgtgggtgggggtaaaaggtaagggtagggggcagatccttcacaaatgtttaaacactatctccttaatgccgcctgtgtgatagtgagttctcctgatgatatttgcagctgtgggattgagtgaatactgtcccgctgagttttggacttgtgttgggcctgtgggcccatttgtgctatttttatgggaaatttcttccctttggactgagaaagcttacccaatgcccataccatcattgtacctggaaagaaaagaactccattttaaattcagggactcataggcagaagagactgtagccttgtctcaggagagactttgaatttttttacatttggaatgcgttaagacttttggagatttttgaaaagtcatggttgcattttgctctgtgataaggacatgagattctgggatatcagggtcagaataatatggtttggctgtgtgtccctatgaatctcatgcggaatcgtaatccctaatgttgaagcgggtgacttaattatggacgggaggttggtggtggtggaaggtaaaagggatgggtaggattgggaggagtgggtcggtagtagagtggtgggagggtgggtggtagtaggaaggaggagtagcctgctgcagagtgagggactcatggaaaaccctctactagggcagtgcacctgtggtttgcagggtttagctcctcagctgttctcatgcgcgggactggtattgagggcctgtagcttttcctcactgagggtgccagctgttggtgggtctgtgaatctggggtctggacggtggtagccccctatgtgggggctccaagtccatattttccttctgcactgccctagtagaggtttcccaagaactctgcatctgcagcaggctgctgcctggaaacagtgggaggtgggtgtgggaggcatttccttcaccaatggttaggcagcatgtgcttgatgctgtcttcatgatagtgagttttcatgagatctggttgtataatagggcatgacacctttttcctctctcatgcttgctcctgctcctggcatatgagacatctcattgccccttgacattctggtgtgattgggaggcttcctgagtcctctgagatgcagaaactagtatgcctccttacatcctgcagaatcattaacaattaaacttcttttctttttgatcattgagagcatttttaatgcaaagaagatctattaggtgtcttcaaggccttttcccccatgtcttggctatcagtactcagcttcttttcattcaagtctctgaatcctccttgaattttccccctgaaaatggacttgtcttccataccacattgccaggctttgacaaagataggtgataatgcaggaacaggttcagaagagggtagcagactgagttcaggagagtttggagggcttccaagacaagaaattgaggggaaatttggatctttgtaaagaattgttaaatacttgtgatcagaaggctcacaggaaaatagacagtaaagatcagacttagaaggtctcagatgaagatgaggaacttactgggaataggagccaaggttagttttgttttgctgtagcaaagaatgtggctgcacattgaccctgccctggagatatgtgaaactttgaacttgagggtgatgacttagtgagtatctggtggaatgaacttctgggcagcaaagctcaagaggtgtcctgtctgcatgaaacagcccttgcccttttgtgtgactgaggaaatgacctctggatgggtcttacattaaatgagtcacaactcttatattaaatgagaaacagaactcaaaagtctggaaaacttgcagccttgccaagtggtcagaaagaaaagccgattttcagtgggaaaattcaagaaggcttcaggaatttgcacgaaaaggagcccggtgctaatagccaagacaataaggaaaagaccttgaaggcatttcagagacctttgcagcagcccttgctgtcacaggccctggggcctaggagagaagcatcgtttcctgggccagttccatgagccccctctatgtgcagcctcaggacactgctgccggcatccctgcagctccatttccaactccagtcatggctgaaagatgcacaggtagagtttgcatccctgcttcaggggtgcaagttccaagccttggtgtcttccacatagtgttaagccagcggctgcacagagcacaaaactagaggcttgggggcctgtgtctagactccagagtatgtacggaaaaacctgggtgttcaggcagaagcttttccaagaggcagagcctcatggcacacctttaccagggcagtacagaaggagaaaatggggttggagtccctaaatatggagacaccattctccagaccttagattcatagatgcaccaacagctggcacccttagtgtggaaaagccacaggcactcaacacagcccagcccatgagggcagctgtgggggatatatcatgcaaatccacaggtgcagagttgcccaaggccttgggagcccagccatcacatgcctgtgctctagatgtgagatgtagattcagaaaagatgatttggagctgcaggattcaatgactggcctgctgggtttttgacttcatggggtctgtaagtccttggacttttcagtaaatgctggaatgagttaagtcattgggggacagtagagaagtcatcattgtattttgcagtgtgacaaggatacaagatttggggaccaaaggccagaataatatgatttggttctgtgtccctaccaatactcatgtggaatcgtaatggggaatgttaaagttggagcctggtggaaggtgacttaatcatggagaagagtgggggttggaagtaggggtttggggagaatgggggagattattttgtgggtgggggtgaaagatgaggataggggggtggattcttcacaaatggttaatcactatctccttaatgctgtctgcatgatagtgagttctcttgatgattatggagcttaaagattgagtgaatactgtcctgctgggttttggacttgcattaggcctgtggtcccatttgtgttatttttatgggaaatttcttccctttggattgagaaagcttacacaatgcctgtaccatcattgtaccttgaaagaaaagaaatcccttttaaattcagggactcatatgcagaagggacagtagccttgtctcaggtgagactttgaactttttacatttggaatgagttaaggctgttggaacttttgaaaaggcatgattgtattttactctgtgataaggacatgagattctgggatagcagggtcagaataatatggtttggctgtgtgtccctatgaaaattcatgtggaattttaattccaaatgttgaagttggggcctgggggagatgatttaatcatggactggaaggggttggggtggaaggaaaagggttggttagggtggggaggagtaggctggcagtagggtggtgggagggtggtgggtgggaggaagggggagcagcctgctgcagaggcagaggctcatgggaaaccctctactagggcaatgcacctgtggctttgcagggtttagcccctgccgcagctctcatgggctgggctggtgttgagtgcctgtagcttttccacacaaggtgtgagctgttggtgggtctatgaatctggggtctggaggttggtggccatctgtgtgggtgctccaagctcatatttcccttccgcacttccctagtagagttttccaagaggctctgcctctgcctcaggcttctgcctggaaatagtgggagttgggggtagggggcgaatccttcaccagtggttaagcaccatctttgtgatgctgaccttgtgatagtgagttctcatgagatctggttgtataatagggtgtgggacctctctcctctccctgtcttgctcctcctcctgccacatgaatcatctcattgccccttgacattctggtatgactgggaggcttcctgattcctcttagatgtagaagccactatacttccttatagcctgcagaatcatgagccaagtaaacctcttctttatgatcatagagaaaattagtactgcaaagtgggtctattaaatgtcttcaaggccttttccctattgtcttggtagtgagcactcagcttcttttcattcaagtctctgaacccttcttgaattttccccctgaaaatggacttgtcttcccttactacattgtcaggctgcagcaaagatagctgataatgtagaagcaggttcagaagggggtagcagacagagttcagagagtttggagggctttgcagacaagaagttgagggaaagtttggatctttgtaaagaattgttacatacttgtgaccagaaggctcacaggaaaatggtgagtgaaagccagacttagaaggtctcaaatgaaaatgaggaacttactgggaacagaagccaaagtgacttttgttttgccttaacaaagaatgtggctgcacggtgaccctgccctggagatctgtgaaactgaacttgagggtgatgacttactgagtatctggtggaatgaactgggcagcaaatctcaagaggtgtcctgtccccatggaacagcctgtgctcttatgtgtgatggaggaaataacctctggatgggacttacattaaatgagtcccgtctctcagaactcaaatttaggaaaatttggagcctggccaagtggtcaaaaagaaaagctgattttcagggggaaaattgaggaaggcttcagaaacttgcatgaaaaggagcccggtgctaatagacaagataatagggaaaaaggccttgaaggcatttcagagacctttgcagcagcccttgctattgtgggccctggggcctaggagagaagcatggtttccttggccagttccatgagcctcttctatgtgcagcctcagaacactgctgcctgcatccctgcagctcaagctccagccatggctgaaagatgcacaggtacagctcaggtcactgcttcagaggatgcaggctagaaaccttggtaacatcctcatagtgttaagccactggtggacggagtgtgagactagaggcttgggagcatctctatagattttggaagatgtatggaaattcctgggtgtccaggcaaaacatcccaaaaaggcagagccttatatcaaacttctactagggcagtgcagaaggaaaatatggggttggaactcccacactggagaccaccatcatgcagaccccagattcatagaccccccccccaaaacttgtttcctcaatgtggaaaagtcacaggcactcatcaccagcccagcccatgagggcacccttggggcatataccctgcaaagccacaggtgccaagctgcccgaggccttgggagcccagccctcacacccctgtgtcctggatgtgggacagggtttcaaaaagggtgattttggagctgtaggattgaatgactggccttctgggtttggagtttcatggggccagtaagtcctatctgtgttttgtttttttttctggcaaaattcttccttttggctgggaatgcttacccaatgcctgtacaagcattgtaccttggaagtagttaacttgctttatatttcagaggctcatgggcctaagggactgtagccttgtgtcagatgagactttaggctttggacatttgtataaatgctggaatgatataagattttatgggactttagggaaggcatcattgtattttgcaatgtgagaaggacatgagatttggggagtgagggaaagaataataaaattcagctctgtgtccctaccaaaactcatgtggaattgtaattggaatgttaaaggtggggcctggtggaagatgatttaatcacggtgcagagtgggggttggaagatgggggtgtagggaaaatgggggaattatggtgggggtgaggggtgaaaattggggtggggggtcagatccttcacaaatcattaaacactatctccttattgctgtccttgtgacggtgagttcttttcatgattttagaactgtaagattaaatggatactggcctcctgggttttggacttgcattgggcctgtggtcccatttgtgttattttcctgggaaatttctgccctttggattgaaaaagcttacccaatgcctgtaccattattgtaccttgaaagaaagaacattcttttaaattcagggactcataggcaaaaggtactgtagacttgtctcagatgagatgttgaattttttacatttgagttattgttggaatgagttaagacttttggaaaattttgaaaagacatgaatatattttgctctgtgagaaggacaagagactgcagggtatcaggtcagaataatatgatttggctgtgtttctttaccaaaactcatgtgaattgtaatccttaatgttggaggtgggacctggctggaggtgatttaatcatggatgggagggggaccggggatggaaggaaaggggtgggtagggtgaggagtaggttgttagtagggtggtgggtactaggaggggggagtaacctgcttcagaagcagaggctcatggaaagtctctactagggcagggcacctgtggctttgcagggtgtagcccccatggctgctgtcatgggctgggctcgtgtggagtgcctgtagcttttctgttctgagagtgcaagctgttggtgggtctatgaatctgcagtctggaggatggtggcctcctgtatgtgggctccaagcctacattttccttctgcactgccctggtagaggttctccaagaggctctgcctctgcaggaggcttctacgtggaaacagtggggggtggtgtgggtggatccttcaccaatggttaatcttcttgatgctgatctcctgatactgagttctcatgagatctggttgtataacaagtgtggcacctctttcctctctctgtcttcctcctacacctgccatatggaacatctcattgtcgcttggccttctggtatggtaggagacttcctgagtcctcccagaagcagaagccactatgttccctttacagcctgcagaactgtgagccaattaaacctctttttaaaataatactacagaaaatttgtactgtagagtggagctatgaaatgccctcaaggtttttttcctgattttttactattaacatttggcttcttttatatgcaaatatctgaagccttcttgaattttccccctgaaaatggactttttttcttttaccacactgccaggctgtcacaacgatagctgaaagtgtagaagcaagttcagaagcaggttcagaagctgggtaacgaccgcaggctgcacagtttggagggcttggaagaagacagaaagatgaatgaaagttttgactattgtagagacgtgttaaatagttataattaaaagggtgactgaaggatggatagtgaaggccaggcttagaaggtctcagatgaaaatgaacaacttactgggagcagaagccaaggtaacttttcttttgccttagcaaagaacttggctggatggtgcccctgccctggtgacctgtgaaactttgaacttgagggtgatgatttagggtatatctggtgaaatgaacttctaggcagcaaagctcaagaggtatcttgtctgtattgaacagcctgtggtgttctgtgtgaccaaataaatgacctcaagttgaaacttatatttaaatgagaagcagagctttgaagtttgatttacagcctgcccaagaggtcaaaaagaaaagctgatttttagtgggaaaattcaagaaggcttcagaaatgtgcataaaatggagcccagtgctaatagctaagacaatgttaaaaaggccttgaaggcatttcagagacctttgcagcagagcttgctgtcaaaggccctgagttctaggaccaaagaatggtttcctgggtcagtcccatggtcgcgctgctgtgtccatcctcaggacagtgccgcctgcatccctgcagctccagctccagctccagccatggctgaaagatgcacaggtacagcttgggtcactgcttcagagggtgcaagctgcaagccttggtggcttccacatagtgttaagccagcaggtgcacaggcttgggagcctttgtctagactcaagagtatgtaaggaaaaacctcagtgtccagctgggcagaagcttttccaagaggcagagcctcatgggaaacctttactagggcagtgcagaaggaacatacagggttgatgcccccatacagggaggaaccattttccagaccccagattcatagacccaccaactgcttgcaccctcagtgtgggaaagccacaggcactgaccaccagcccagcccacgagggcagctgtggggaaagaccctgcacagccacagaagctgagctgcccaaggccttgggagccccgccatccactcttgtgctctagatgtgggatgtagatcctttcaggaaagatgatttggagctgtaggatggaatgactttcctgctgggtttttgacttgcatggggtctgcaagtcccatctgtgttttgtgcttccctctgacaaatttcttccttttggctgggaatgcttacccaatgtctctacaatcattgtaccttggaagtagttaacttgctttgtatttcagaggctcgagtagaagggatggcagcgttgtctcagatgagactgggctttggacatttcagtaaatgctggaatgagttaagactttgggggactgtagagaaggcatcattgtattttgcagtgtgacaacgatatgagatgtggggggacctgggtgagaataatatgatttggccctgtgtcactaccaatactctcgtgaaattgtaatggggaatgttaaaggtggggcctggtgggagatgatttaatcatggagaagagtgggggttggaggtgggggagtggggagaataggagagattattttgtgggtgggggtgaaaaatgaggggggacggattcttcacaactggtgaaacactatctccttaatactgtctgcgtgatagtgagttctcttgatgattatggagcttaaagattgagtgaatattgtcctgctggggtttggactgacatttttgtcatttttctggggaatttcttccctttggattgagaaaccttacttaatgcttgtactatcattgtatcttgaaagaaaagaaatgccttttgaactcagggactgataggccgaagggactgtagccttgtctcagatgagactttgaattttttatatttggaatgagttaagaattttggaaacttttgaacatgcatgactgtgttttgctgtgtgagaaggacatgaggttctggggtatctgggtcaaataatatggattgactgtgtgtccatataaaactcatatggaattgtaatccttaattttggggcctggtggtaggcgatttaatcttgaatgggagggggttcggggtggtaggaaaaggaggggtagggtggggaggagtaggttgtcagtagggtggtaggaggatggggggtagtaggaagggggagtagccttctgcagaggcagaggctcatggaaaacctctactagggcagtgcacctgtggctttgcaggctttagccccatggctgctctcatgggctgggctggtgttgagtgcctgtagcttttccatactgagggtgtgagctgttggtgggcctatgaatccgggatctggaggatggtggcctcctttttgggggctccaagcccatattttccttctgcactgccatagtggaagtttctcaagaggcttggcctctgcaggaggcttctgcctggaaacagtgggcggtggtgtgggtgcaggatcttcttgatgctgatctcctgatagtgagacctcatgtgatctggttgtctaacagggtgtggtacctctttcctctctctgtcttgctcctacccctgccatatgaaacatctcattgccacttggccttctggtatgattaggaagggcctggtcagtgtgggcctggtcagtgaactagtcagttgggacttggtcagtgaggcctatttactgggggaatggtcagccagggtctgcttagagagggtctcattagagggatcgagtagtgcaggtcttggtgagtggggacctagtggcagacaaatgtttggtgtctggtcagtgcaaacctgggctgcagggcttggtgagtggagacctggtcagctgtggcttagtggtagccttgtcagaatgggctgggtcactggtgacccggtcaaggggtgctattcagtggaggcctggtcacatggcacctagtcagcagggcatgtcctcatcagtgagacccttgtcagtgggaccctggtcatggcagcctggtcaggtcagtggaacctaatcagtgggggcctggtcagagaggacttgatcagtggtggcttttgtagcactggtctatggggtgacctggtcaacgggggtctgagcggtacatgcctgttcagtggtgcctagtcactaggttcctggtcggggcatctggtcaccgcaggcctggttagtagggacctggtcactggcagcctgttccctggagacctggtcagtggggcttcatctgtggggccaggcaatggggtcatgattggtggaatgtggtcagggaggccttgtcagtgaggccctggtcagtgaggccttgtcagtgaggtccttgtcagtggggtcctggacactgtgggcctggcagcgggaatctagttagtggggcctggtgatgggggcctaatcagtgagagtgtggtcagggaggacctgatgtgcgggatctggtcagcagggacctggtcagtggggctgctgagcactgctgggaggtgtcaggggaaatgcatgttatcaggggccctatggacagctgggatggcccagtggtgtccaatggcccagtcaaaagtggacaaagcaggtgtttggatggacctgggagatcttgctcagagattctgaaagaacaaaggtaaaggaagggccagagtggctagagagatggtaacagtctatgggctgcacaggatggaggaagccagggaacaggcagggtgggcagtaggggtgcagggagaggcaggtgcatgctgggaggtcggaccctgtgagggctgtgggggcgtcaggtggggtgggctccaggtgcactctcagtgtgcactgggcaggtctcggtccaggctctctggaccctggtcgggtgatgtggtcactccctgggggactgctgtcaggcctagccacccacccttggcagcactgtcccatctcaggactggactttctcagatcctgcagagggcacagcctccagcccaggaggggcagccccttggtgcagcctaagctctccatgggcctggagcatccctgccagccctgcgctccctctactcccaggtcccgcttttcaagtgtcagccagcagagaggctccgtcctcccttccctatgtgtctcctgggctaaaacttggggcgcattgggacagggatggtgctttcctcaggcccatttagggaggggactggctcccagcctggcacaggtcctcagctctgccttggttgccttagagtgacatggatcagtcagtgccctgaaggtaaatggaagagactgtccctgctgtgtgggaggctggtctagggatggaggacttggcaggtcctcccagtctgtcaggcctggacagcactgtcctgtctcaggactcagaaaatccggtcttgggatgggacggtgctgcccagggtgggtggccagggcttgacagcagtcccccagggagtgaccacatcagccaaccagggtccagggagcctggcctgagacccacccagtgcattgagggtgcacctggagcccaccccacctgatgcccccacagccctcgcagggcctgacctcccagcatgcacctgcctctccctgcaccccagatgtccaccctgccttttccctgatttcctccatcctgtccagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacctaaactctttgaggaaccacagagcccaaggctggaaacctccagaatcctccagcccctgatcccccccccccccggggacctctgtggcctgtctcaccagagcactcttctgtctgtagaggtctcaggtgctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaggaggtagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagaaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaactatgtttctgtcatctgtacattgagaggaatttcttttactccacgaggctgcttggagaattagtgacagtgtgtgtagagcatgtgccacccagcaggcatttggtgtcgagaccacacctcctcccccttcattttcagcctaaatttgcattttgttcttaagactttcactcgccttaattttactctttcctctgattcccaccttatcgtctatcccatggagtcactaggatctaagtgggtaacagtcatgtatgcatgtatgtgtatgtacgtatatactttgttggtgttggagtgtggtgtgtgaatgtgtgtgtgtgtgtgtgttggagttactgggtgactgaaactgtacacatcaggctgtggttctgcccattgctggaagcgctgtcaggggtcctgccctcaaccccaggtctgacccttgcagcgcaggcaggacattctggaggaatcatgcccttgggaggatccctgaggagtgactggtgggtattggtggataaatacccctggtcccttgctctgggtatgatgactctgaagcacatgttctgtgctgtctctcagaggtacctggcagggctgagtcctggctgccacagtggaaactttcttgatgaaggtccctttaactgctgcattcctttcctgtctcagttccccactcctccactgatgtttcctgggattagcaccctaaggaagaactggcagtcgaattaatatcctagcgttatctccaaacaaaatttttgtatttgaatctttgcctcaggatctacttccaggaaattcagactaagacacacatttttcttttggctccttgaatccccataggcctgacattttgctgtttttatcaaaaaggaacatgaggatcagagagggaaagtcacttgcccaaagtcacccagctgaacagtggtagagttcaactttgatcatgagatgtctggcccccaggtggaggcttgctcctctcccatgagactccttccttatcagggtcaaatgaatgaatggaggatgttaaaagtggggtctctgatgcctttgccagataaaccccaggctcatggctggcgcctgttttctcattcttacctcattaagagtagtaatgaaaaacatgctcagtgctgaccgtgtgcctgggggtgttgtaggcactccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatgattggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagtcaggttctggcagggacctcgaagtggctggtaatgtctttcattaccaccaccacgtgacctggtcttacgacctgttagcttccttcatcaggcatgagcaccaggatggcaggggcctcatctgtcctgttcctcctgtggcctgggtcctagcaccatgtctggtacagtgtaggtgctcaagggaagtttactttatagaactgtctacctgggagatgttgctgttagtctaacctgtaccattttgtaaacctgcagccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaactgtctttctctgtctttctttaacccttgccttgccttcaaaatctaacaatagctctacctctccattttaccaaggaggatatgagactcaaggagagcaagagacttacccagaattacagagccagtgagtcacagaacttgaacttgagctcagttcagctgaatccagaactcatgtcttcctgagagtccagggaaggaaaggtggaactgcagccagtgggtgcccacaggcttgtcctaggagaccacatgcagcctcctgggaattgtgtcctcttgggcacaaaagaagaactgttcacctgtgctgcatcagctaagtgtccccattgtcccaaattgttgtattttttcaaagtttcattttagtaactagatttctcacagctcagtgttgaaaacaaagcacagaggcatatagaaagccgtgtttgggtttttctcatttttttcccagtgactatacaaatgaatgtacaaaagagcacaaatacgctcatactttttatatagagatgaggccccccccactcatattcctctgccactacccttcctttttttttttttttttttcttttcatgggaggacctgtctttcaatactagtccatgtgatttgggaaggctgacccaccctgggcaatcagatcagcagggtaattgattcaggagtggtcatgtgatccaagctgggctcatggaagtcatccctgaacttctgatgaaactgctgggaatgaggtgcttactttttattggcatatctatttgtaaggaagtaagtgatgtgaactttatggggccatttttgctgctctctcaaaacagcttgcctgaaaagcagagctgacacaggaaatgaagggacagaatgagccttggttgatattagttgacccctgatcccactgagacagaagcccatctactcatgtacatttttagtaagtaaagccaaataattcaatgttctgctggatccagttaggtttcagtcacttgcagtcaagagagtcctgcataatagcactttctgtgatgcttaggtcccacctgccagagctttagaactgtagaagggtaaagtgaacccaggcagtgctgagctagccaatctcctggctaagtgtgcaaaggaaccctggagtcactaccactttggtctgaaaaatagccttgcctgctgcttaccatacagccataggggtattgcttccctgagcctgtaggcattatacctctttttaaaaatgatgtttatttaagaaaatgttttgtgtagatggtgtcttgctatgttgcccaggcttgtcttgaattcctggcctaaagtgccgagattataggcatgagccactttgtttggccagcagtatacttctattagttgtcaatgcttttttgttctgtagtttctagtgtgtgcttgaggatgcgtgtgtatgtgtgagtttatgtgtgtgtatgtatgcgtgagagtgtgtgtgtgagtttgtgtgtgtgtgtgtgtgtgtgtgagtttttacctttatcttgcagggttattgcaagcatcaagtgggatcccgtaggcgcagtactcagtccagtgactggcacatacagtgagctctctctgttctcttttctcctcctgattcagagaatgacttaaggatctgtgacgtgtgccagttttcaacgccctgcataaataatggggagtactgttgccataactttgcactagttttaattcattttatctgtttagcatgagatacctcaaagtccctgaataaatttatgtcatatatatatatatatatatacacacacacacacataagtatgtttcttgagagctgacaagcttagttttggttccctgatgctgcagtagaggccactgtgttctgatttttgagtgatggctgccagctctccaagtgtcacagtcagtgaggcatccatgggggcaagcgccaaggatgagtgtggccagtcagcatctgcaagcccgttttgtctatcctctttatttttataatatgttttattcattttttaggtttatcatttaatctgttgtaaacttctctcctaaaatgtttcttagttctactaggggttagtttcatgaaacaagtccagaaatagtccacggcagccagggatacacaacatgccattggggagggagaaatcttgtagattgaaggttttgttgtagggacaatctttccaatggtcttcaagttgctaaacccaactcagggcatttcatcctatttccagagagcagcaagcagagaaagcaaagggaaattggtcaacaaaaaagaggaacaataactctcccctttccaaacagattttcagaaatccaaagcagtgaattctgcatttcacattggccaggactataagattcgctcactacagttacgagaaaaactgggaaactcatttaaagacgttaaccagggccaggcatggtggctcatgcctgtaattccagcaatttgggaggccaaggtgggagaatcacttgagcacaggaatttgaaaccagtccaggcaacataacgagacccagtctctacaaaaacaaaacaaaacaaaagctgggtgtggcggtgcacacctgttatgcctgcagtcctacctactcaggagtctgagctgggagatcacatgagcccaggagttcaagactgcagtgagctctgatcatgccactgtactccagcctgggagacagagtgagaccatttttcaaaaaaaaaaattataaaataataaaatatgcataaataaataaataaataaagacatttaaacagtgctccttggaaaaagtgaatctatgttcccttagtgaagaagatgagaataatggatatagcagggaaatggacagcattggccacattagaccaaaatgaaagtcataacaggtaccccaaatcagtaccattaaaaccacataatgtgaccataatgcagtcaaattgtgaccaacaaaaaacaaactgacaaaaaaggtatcatggagcatacgaattctaaatctaaattgaatggagctcagaagggcttcccactgaaaatgaaaccatgtgtatgtaaatgaattgtaacaaagctactacatagcaacattaaggtggcagagcggaaaggttgctaagacagatatctgtcatcttgtaccattttttaagaaaggaaaaactacaaaattatgaatttgagttataattgagggataagacaatgataaagtcaataattgttaacgtttactgtgcttcagtcctaccctgtgctcattcatgcccaataagtgaagagctggaactgaaagctttcttatatttattcaattgtagtctccctccagggtgtggaatcatgtataaaggagggatagtgtttaaagaggtattttctgcattttttacttccataagcagtctctgctgtgtgagttcttgtatgaactatgagtctgagacaacactgaggcttttttcatattccttactttcatagcttctctccagtgtgagaacaaatatctactcacgatgaatgaagatgaaaggctttccatagactttaccttcagagggtttcttttcacacttctgtaagataggagagttcaggaaagatgttctcatgcatgttaactcattgagctcccttccagtatgtcctcctcacatgttcagtacggtgaaaaattaatgatgatttccctgccactcacagggcttctcactattgtgaatcttaagatggcttttaattctggtgactttgcaaagtctttttcacatttatcacatttatagggtttcttccagtgtgactccttatatgtgcatgttttgagccttgctgaaggctttcccacattccttacatccatagggcttctccagaatgttctttcttaaatatttattaaggtgtagggaatatctaaagcctttctcacttttgttacattcataaggtttctctccagtgtgaagtttcatatgtctcataagaaatgactgataacgtaaaggctttccttcatttgggacatgtatggcttttctctccagtagtactactcctgtgtggaccagaatttggagcaggacagaggtttttccactttgatgattcttattcttcatctctacagaacagaactgcatctggacagcatggactgagttatttctgaagatgttttcacattgagtaaaattatacattttctccctaacatgagttatgtgtgccctaaggcacatgtcttcactacaggctgattcaaatggactccactcatgaatgtttgtccttgtattaattttactatgtatatgatggacattgttctgactgcctgtccatgtgtttgattttagctgtttttctcccatatgaaacccagtgaatgttgcacttcaagactatcatgttgattgttttcatatatattactttattgcaatagtttttgggaaacaggtggtttttggttacatggaaaagttatttagtggtgatttctgagattttggtgtacgcattactcaagtagtgtacattgtacccaatgtgtagtcttttatccctcacccccctaaccttccctctgagtccccaaagtctattaaatcattcttatgccttcactctctcatagctaagctcccacttataagtgagaacatacaatatttgttttttattcctgagttacttcacttacaataatcatctctaactccatccaggttgctgcaagtgtcattatttgattcatttttagggctgagtagtattccatggtgtatctataacacattttctttgtccactcattggctgatagacatttaaccttgttacacatttttgcaactgtgagttgtgctgctatgaatgtgcatacatgtgtctttttcatatgacttcttttcctctaggtggatacccaggagtgagctgatactaatttaaatagagataattataaaataaagtaatgaccaagtgaaaattaccatttctagtagtaaaacaagatacctttattgagtaaagcttgaacatatttctgcccacataaaggacatataacttttgtattttgtataaatgatatgctttatctcactagactcatcctatggttaattggtgggggatggttggagaaagtaacatatctttaaatttagcttcttgattcacatttttcttcaagtttcaatagctctcttttagttaaatgcctccaggaagatgttcagatgctttgggctttctgtggcctcaaggcaaagggaaagtgaatctgaagtctcttattgtcttcatgctgttctctagacctctgctttctctgtggcagagggtctctctggtctgatcgctggggccattgcattgctattctctgaggtgaagcttgtactctcgcatcagagtacagtggaattctcttgctttattagcctcctgttggcttggataagatcttcagatctctgtgagtttcagcatccttcttccacagtatgtctggaatggtcacatgggactttttggcaggatcattttgccccttggtgcagtggccccatgttatgtatgttagttttcaactcagttaagttgcttcttatttacctctatgacacttccacattgcatagattcataggtctagtaggaggttttttatataaaccaagctgccaggaacagaacaatgctcgcacagtaagtcagacaaaccaaatttattactcacagaggagcaggaagaatcagcaaaaccgttaagttctatggcaagcctgacccttgaggtcagaaaagttgcccagggttggtggagtctcctctgcacatgccccactgtgtactgcgctgaggaacccctgagtgctccgccctaggtttcacaccccacgtgcaccttggctctctgagtttaagggctgcagtaatatcctgttctaggaacaacaaggacagagcccagactgtcccagacggtttctactcatctcaggatattgtcttcttggaacattctaaagttattctgagaactaggaggtacagaaagctgagttggtcaaggccattcaggtcttgtcctcctgaccacagaaacaaagtagactataaaacaataagcattggcagaagtaatcatattgcattatgatagccattcttcattatgataaaaagaatttatcctccaaaaagttatctgagttctaaatctgaatgaacccagcaaaacatagatttgggactgttgttacagtttaataaaatatatactaaaccaataaatttaattaaatacataaactctagaagtataaaaatcataaaggctcatttcagtaaaggttggcatacaaagttatcagatgtatgacagagtaatagaaaatgttgacactgcttagggcaaagtgaatatgattgatattcagatgaacaaagaagatagtaaactcaatagaaaaatgggccaaaaaattcaatacattgttaacaatctgacaaatgcaaatgtacacaaataaaatgagatctgtattttcaccacttgcttagaaaatataagaatcctagataacattgagtgatgaggatatgaggaaaacaagctttatgggcaatggatggaaaattaaatggttttaaccatttcagaaaataacatgacaggacccatttgaaagtatgcatactctacaacctgtctcgatgatgggtacatatccctgatataatttggatgtgtgtcccctccaaatctcatgctaaaatatgatccccaatgttggaggtggggcccagtgagaggtattggatcatggggtggatgccttatgaatagcttagcacaggaatgtccaaccttttggcttccctggacagcattggaagaagaattttcttgagccacacataaaatacactaaaaatagctgatgagctaaaataaataaatacataaataaataaaaataaaaaaaccacacacacacacaaacacacacacacacacacatacacaaactctcttttaacaaagttgacaaatttgggccacattcaaagctgtcctgacctgcattcagcccacaagctgtgggttagacaagcttggtttagcacaatccacttgagtgagttcttctcagtgagttcatagagatctgattgttagaaacagcctgggactgcccccttctctctcttactccctctctgaccatgtgacacactggctccccttcaccttctgccatgattgtaagcttcttgaggcctcacccagagcagatagcattgcttcctgtgcagtctgcagaaccccgaaccaagataaacctcttttattaaaaaataaataaataaattacccagcattgggtatgtcttcatagcaatataaagagactaacatagcccctgacaaattgtaacacatgaccaaaaagtgttttcataaggataccataaggaagtgaatatttcagtagcaggatatcagtgtgaattctactgcaagactggatagggaaaatgtggttgattcattttattgaaaactatgcagcagctacaggggaataaacaaccaaaaataacctacagcaatgtgggaatgtatgaaggatgttatgctctgtgaaaaaattagaaataaaattagatttatagcacaatactctttaagcaaaatgtatacactcacgtatatacacatacacacactcagaaaacaaccttcttatcttgtaagaattctttaagagtaaagaacctatatcaaacacattagcatgcctgtctgtgacaagggataaggaataaaaaaatgaaacaagtaaaaccagagaaacttgtaggaaacaataatgataatgtctcatgaagtaaagaatgtgattaattttttgcaactgtggtataaaaacagattgtcaaaatcaaatgtaatgagctttagcatagagcttattgtagggaaaaaatcaaatttaaatacttagtttatatagtttgatgcaggaatggtctcctatgtgaagtagtaagatacactaaacaatccatgggtgtatgggaagaaaatactcaaaatgctacttacatttattttttactcatttttccaacagtttaatatctaaatgctaggggaggccagatgtgatgactccctgtcattacacctgtaatcccagtgcttggttggagagggtgggggtcaaggcaggaagaacacttgaggccaagagttctagaccagcctgggaaacctagtcggtttttgtgtccacacacaaaaaaattaaaaattagccaagcatgatgtcatgcacctgtagttccatgtactggagaggctgaagcaggaggatcacctgagggaggagtttgaggctgcagtgagcaatgattattccactgcaccatagcctgggtgacagaatgagaccctgtctcttaagtggaaataagtaagtgcgaggagaacacgtgatctttctagttttcagtccctcttgcagttccctgtagattattttgcttattcccaatgttccagctgtctgcacattgtaggcttgttcttctacctactcaaggccccagatccagcaaatgtcctcagagatgggctctgctgctaatctgtgatcaccaaggaagggcttgtttttctctgaaatttagttcattgacactttagacccacaattttttgatggctttaaacaaaaaaaaaataattttttaaagttcatccgatattttctcattatggcaggagcaattgtctttggtaactttattttaattggaagaagaatttctaacattggcattgtaatgaggtttttggtctttgaccctagtggagcaattaaatccacgtctatttcttctgttatgcatgtattgaaggatcaaatgagaaaatatatgtagagtgcacaaagtgtctaatgtacactagtgatatacagttgtattatgactacacaccgaaaacacataatcaaccagattgcttcctgagaactagagccaggcttttccaatgatacttaactgtcaaataattctattcaatttttcatgggacttagggtttggtccatgaagtgctgccacagtatgcaaatcaattatatcaataaatgtgctaatttattcagcaaacgtattcttgtagcaatagttactcaatgaaagaagtaacatatttaatttctagtagaagctacttctctcattgtgaactcggtacaaagcttgaatgctctagctattttgaggagcattaataagcattacctaaagaagatgatatattccctagacaacaagaactcttatttctctttatcttctttttgataaatgctacagtctcttggtagtgaatccagattctgtggtgtggggaaaagaaagagagatcagactgttactgtgtctatgtagaaagaagtagacataagagactccattttgttctgtactaagaaaaattcttctgccttgagatgctgttaatctgtaaccctacccccaaccctgtgctggcagagacatgcactgtgttgactcaaggtttaatggatttagggctatgcaggatgtgctttgttaaacaagtgcttgaaggcagtttgcttgttaaaagtcatcaccactctctaatctcaagtacccagggacacaatacactacacactacggaaggctgcagggacctctgcctaggaaagccaggtattgtccaaggtttctccccaagtgatagtctgagatatggccttgtgggaagggaaagacctgaccatcccccagccagacacccataaagggtctgtgctgaggaggattagtaaaagaggaaggcctctttgcagttgagataagaggaaggcatctgtctcctgctcgtccctgggcaatggaatgtctcggtgtaaaaccggattgtatgttccatcaactgagataaggagaaaactgccttaaggctggaggtgagacatgctggctgcaatactgccctttaatgcaccgagatgtttatgtatgtgcacctcaaagcacagcaccttttctaaccttgtttatggcacacagacatttgttcacatgttttcctgctgaccctctccccactattaccctattgccctgccacatccccctctctgagatggtagagataatgatcaataaatactgagggaactcagagactggtgccagcgtggatcctccatatgctgagtgccggtaccctgggcccatgtttctttctctatactttgtctctgtgtctctttcttttctcagtctctcatcccacccaatgagaaaaacccacaggtgtggaggggcaggtcaccccttcatgtgggatgtacaaaacaatcctccacaaatttaaatttatgcctatgatcatgtgtaatgaaattagccctcaagagccaacttgagaccatgttcagaatgaaagcttcagaaacccatggcaaacacatgaatataaggccattttagacacagtccccagattacctctgaattcagtggggaaaaagtgacaaggagcaatatttagggcatctaggatagtgctaccttctcatccctaacataagccaaattaaaacttcatactaatgctctgaagcctaataataactagtaaggtttatgtctgtcaaaaagccactgcaggctactgttaaaaccagctacacaaccatctggaagacatttgcctccttctggttaaaaacagtcccatgtctactgatgatgtagttaaggttgtatcaagatcttctatctctcagcagggatgtggtttcccaaatgctaatatttgaccaacaaaagttttgcagccagagtttgtgcaagtattggtagatagaaaatacaaaatccaaccatttctcatgaatgattaaacaaaaaaaagaatgcaagaagcctgtgtgcatgtgcgtgggtatatatgcatgtgtgtgtgtgtattcaggtttgttaactttattaactttgtttaaaatttaatttaaaaattagattggggagtaaatatcattcttcctctctcatcataaaacttttggctcacgggattctgacattccatcatgcttggaaaagttggatttatgaaaccagttgctggactgagcctgcctatgcagctcttacatgggtgctccctattttgtgcacaagcatcctcaagagaccaaagatagtgattgagagagacgggctctgaagtctttttatttcaacttcttggaatcaccaccttgttaatgaacatcaaaatcttttgtgtcatttatcagattaattactttttccataaaaagagtgagttgagaggataacaagaaactccctgtccctgcttcatcctgaaaacaggagaatcaatatcttaactctgtttttgagagatgaatgggtaggtcaacattgcttggctatttgtccttccatttgggacagattaccactgcactttcccctcaatctctagaatcatggcttatagaaaacaattttgtactgaattactaaatgcatcaaaactttattagacttattatcaaagagcatgctcagatgtatctattataaatagtaataaaaatataaaaacctaaaaacaatattataaataacagagaaaagctatgcactgttatgaaagcctttcatatttagggatatcaggtaaggtttcccttggtggggaagatgaagagcaaactaaaataagagtaagagctggctgggtgtggtggcttacacctgtaatcccagcactttgggaggctgaggcaggtgaatcacgaggtcaggagatcgagaccatcctggctaacactgtgaaaccctgtctctactaaaaatacaaaaaaaaaaaaaaaattagccaggtgaggtggcaggcgcctgtagtcccagctactctggaggctaaggcaggagaatggcatgaacctgggaggtggagcttgtagtgagctgagatcacaccactgcactccagcctgggcaacagagcaagactccatctcaaaaaaaacaaacaaaaaaacccagtaagagctaattatataaatctgggatggtagtgggaaaagcatatgagtaagaagaccaaagtccaggagacaagaagaaatacatctgaatcatttagttcaacaatgttcatgccacaagaggggggaaagagaaaggaaacaaattttgtactgcttgaacccatttttggactcttgctatttatcctagtactaatgtgaagtctttgggagtttttaagcaaagcaatttacaatgcaaattgtatttacatttcaagtaatcattccagatatagcacagaaccatttttggagagagaatcagggagagcactttagaggtgtgcaccatagcccaggtgagagagtgatgggctggaatccatgatggcaatgaagatagaaagagaaaaattcattcaagaaatagagagaaggtaaaatctgacaatacttggtgatttgaaatggaaatgtgaagaagaaaatgtcaaaaattaattgagatgtcaggtgtaggtagaagttgacatcatttgctgcaaaaaaaaaaaaaaaacacacaagaagaataccacttttagtgaaagagacatctaggttgcttaaagtatgaaacaggacttttccaatttcatgcaggtaaattaggagggctcaaccttgaagcacaaaagatggtgattatggtaacactggccttgagaccaggacctgtatcagactctagaaagatcagtgtgatttggagctgctacagactggaatatttcagtgaaaaacaaaacaaaacaaagcattcactcttattcttgcagtcttgttttatttgaaggagtaaataattgggccttattcagagctgcaagttttggtaagccctaaaatgaacaaaaaattgtataaaatggaaacaattcaccaattctattcacttaacattttctgattttcttccaggtttaagtattatgataggcattgtacagtaattactttattgaccatcttctctggtgtttgtattaatacacaaagaaatctaactttaaaattgtagcattgctttcagctgacaccaatcattacccgttatcccaattcattaaatcagattgtttcagcaataagttacattttgaagttaacgaaatacttaaaaggctgtgatgttgtagctgcagatgtagtatgcaaaacacatttgattcatgtcgttcagcacaatttcatcttaaaatcttatctacaaaacatttttacacatctattattctcttgctttatgtaaagtttatgtcatttatctctatcaaattaagttacatttctagtttttctcaaccataaaagacagcattaatttttacaaacattaatgatgaactatattcactcataactatttatgtctaagtcatcttagatttactgaacaatttctgagtaactaatggctagccttttattattctatgatgataaacatttttacagtatccaggcttcagacatatttttgaaaacatttctatatgggtcaaaatttaaatcagttgtaatatgtgatccactcaaatatattctccaggatgcgctattaaaatgaaataccgaggtggttccccaagacaccaatttaaagtgtatatgtgcagtgcagggttactggaccaaggcacagtgtaaacagtgaaattttattttttgttttctttttcctaagatgtttcttattccccattatataaaaatatgtattacaggcaaagaaaaattaacacgaatataagtaaatataaagtatattcacattaatatcagctttgctttatctattaaaggatgtaacacacttgtggttttcaggaccttgtaactcctggttcattggaaagcatagaaattcttcagagcctcaagagttgtgtttaacacattatttaaatagtgtccaaccactagttagatagcttagcactcaaatagcctttgaaatctctgtagactcacctcaattgaggagtcctgataatttacagaagtgtgtagtgcactaagagatccctgatggataatgtctttgcctgtggagtgttttatgtgttgatccactggagtgtgtgtgtgtgtgtgtgtctgtgtgtaggtgggtgagtatgggtgggcgtggattgtgtgtgtgtgtatgtgtttacactgtggtatgtgtctgttggggtgccaccatttgggatttggaaaagtgaggaccataaacttgtcaacattcctacatgcctgcttcataagaagtgtactgaacatggccaaaagtaactaaaccaagtaaacaaattagacattaattaaatttaatgctgggcgggaaagaagtattcaaggccaggtaaaatgaagaaatataaccaaatgaatgaaatttttagattgattcatagaatgagacaggaatattttttaaaatttgtagtttctaatgaataacagcatataaaataagaatcatatggctgtcaattgactaaaaactgtacataagatttgagctagtgaaacaaccatatatgatcttctaattccacttttctatctcaagaatgacttgttaaaatgattttttttttgaaattttacattctcatcttgaaagagcttcacaaaacttacatgagaatctggattgtcataagaggtctgattttttaatggtatgtttgtatttttgttatgtacatcaatgtcaagcattcgtttcctgagctgttctctacaacacaatttaacttgtaatggacactcagtaaatggtcggttggatattcaaatcaacaccttagttccatcaattttcacttcatataaaaatgcctgatcttctatactcaccaatgaaacagagagagatgaaggagggagagcagttgagactgagaggatgacaagcagacctcattctgcagtggatttcctacactctccacttctgaatgcttggaaacacttgccatgctcaaaaaatattggtatttcctaggcagcaaatgggagttaaagaaagtccatatttctatattacaataacttacactataatacacagatggcatacatttctaagctatttcagttcacagaaaatgtagataaatttaggtgagcaagatgtaagagaagggttagtaatcaagctgagtgtgattgtgagattaaatctaatattatcttatacaattattgtataattgcatcagttgacatatctgttgaaacagaaggtgggagagttttgcatgcgcttccgaaatgtactggatgatgttaggagagaggcgggtcaacgtggctaggccataagtgtttactaattgaggcttaggaaagttaagctcctaaccagagactgggagatagaggcgctaaagtgtataacatttatatttaatatataattaataatacataataaagtcttaaaatgccagttttaagtcttttcattttcttcttaaaaaacagaggttttattgcgtttggtccacagtcggtatttcacattatctcatagcgcagggcccctgggtggagggctctgtgtagtacttggcgtggcctggggccgggagagatagagcagtagacctggtcaggcccggaaggggagaaggagggccggggctccttaagacctactgagggcctgggcgcggtggctctcgcctgtcatcccaacactttgggaggacgaaacaggcggatcacatgagggaaagagttcccgaccagcctggccaacatggtgaaatcccgtctctactaaaaatacaaaaaattaggcaggcgtggtggtgggcgcctgtagtctcagctactctggaggctgaggcaggagaatcgcttaagctgggaggctgaggtgcagtgaggcgagattactccactgtgcttcagcctgggcgacagagtgagactacatctcaaaaaaaacaaaaaacaaaaacaaacaaaaaaccctactgagggccacgggggtgggggagctaggatggagaggggtcagacttaatcctggcaactcagaattccactaacttgtacgggtctcagtttcctcaccgggccccagcataggtctgagggtctgaggtctgtcggtctgagggtcctagggaaatccagccactcaggagcctgagatattttagcatcgtggctgggccccctctcccaggggactcatttcccagcaccctctccactgtctccgccccattcctcggagaagaaaaaaattttctttcttttgttaatacttcctgaaacttttgcaggtacagaaaccacaaactgatcggctgacaaaaaggggaagaggagaggcaaccagaaaccttcggggactggttccctccatgcccaggtctcttctccccagcacagctcagcccacagcctggaagtgccagcggggaccttcaccctacacgcatcaggatatggccttgatcccttcccccacagcccggtgtctcagtcctgccaaggaaccaaagcaagaggaggtggggaaaaaaccctgctgcctgatcccacgctgccactcacagaccctcggttgactggcagcactgaacaggttaaaaaaaaaaaagatgaaaacacagaaaaacccaacacccagacggggagaccatgtgtggagagagcgtgctgggagcctcagtagccggtctcctcctggtagtaaggggcctcccctggccctgggcagttgccggcggagggagccccgtgggccactgggccacctggctagtacttgggttcgtatatttgccggcctaggccaaagacctggccgctgtgattggcaacctacgtgtagcccatcttcagggacatggaggagttctcacacttgtcgattcccaacttggtgtcatagatgtgccgctgggtcccgggagccgtcatgcccacctggctggcgcacttgtttgtacccatctggaggctgatggtcgaattgtccatggggggcaggatgcggttcttggggtcgtagagatgcctcctcgtgccatatgcggtcatgcctgactggctggcacatttgttggtaatctgcagccggatgacgcactggctggccttcatggtggtgtcgtcgaagttctgcttctctgagtacttgtcacggatgtccaccccgctccgcagccccttagtcttggccttccctgccagggcgagaagagacacccgcacctgcatattgttcccactctcaaacaggttgttggcctcaaataggtccacgggatcatgccgtagctgaccattgccttgaggaagttggagaggttttctagctagtgccagttctacacggaagccgttgatcttggggactgagcccggctgcagtttgttcacgagtgtgcataaaataatcccgtccttcaggcccttctggaagtcggggcggatggagaggccagtgaatcccttgatccagctgcggagctctgcctccttctgggagtcatatttgggcagaagcctgttctggacgtccgccaagagcctgtaggaggggcccttgttgaactgcgtggagcttacggctggagggccaccgcggggcggatccgacaggaccagcggctaagtcttttttctagttcgcaatgttttgttttcaccacaccattgttttactacatattttattgtatgtgtattgtgttaaatatacattttgtgtatttaaaaatgtgtggaaaatgttagaccatctcccttttttccaccttcccttttaccctttactgccatttacatccacacatccacacacacatacatccacacatccacacacacatacatccacacacacacatactgaccaaaattaatttcgatatacgaatgggttatttgaagcgaaaagtcaatctatattagtaaaagtgtcatgccagtatgaattatatttataatcctttcaagaagaaagaacttgcggcggggcgctgtggctcacgcctgtaatcccagcactttgggaggccgaggcgggctgatcatgaggtcaggaattcaagaccagtctggccaagatggtgaaacttcgtctctactaaaaatacaaaaaaattagctgggcgtggtggcgggcgcctgtaatcccagctactcgggaggctgaagaagagaattccttaaacccgggaggcggaggttgcagtgagccaagattgtgccactgcactctagcctgggcgacagagcaagactccgtctcaaaccaaaaaaaaaaaaaaaaaaaaaagaaaaagaaaaagaaaaaagaaagaacttccttaatgttttgaagagactattctgtatccattttataattttgtggccactgaaaaaggtatattaaatcacagacacagtgaatgtagtaagtggtagtttaaaatgttaaaatgttaaatcacgcctgtactcccagcactttgggaggctgagcggggaggatcgcctgaggttggcagttcaagaccagcctggccaacatggtgaaaccccttctctactaaaaatacaaaaattagccaggtatggtggcacaaatctgtaatcccagctactcgggaggctgaggcaggagaatggcttgaaccctggagggggaggttgcagtgagctgagatcaagccactgcactccagcctggacaacacagtgaaactgtctcaaaaataaaataaagtgttgaatttttacaagtcgttgttcctattctaatttttgaatgcaaccacagcctctaacaaaacagcctcgttacactaattcgctgataatgaattcttaagtaaaaggggaattccatagaaatatatatggctcttttatgtttaagaaaagtaagagcctgaaaaacagatgtgttctgtaaaactgaattactttctatccagttccactggttccactgttttatatctttatattaaaacatatataaatgattgattgatgattttttttcttttagacgctgctgctgaatccatggagagaaaaaggataaatttccagaactatggtccctgtgctccagttcgtcaggcgggcgcggcggagacggagaccgaggaacgccgctggggccatgcggcgctaccgcgcgtggtggctctgtgtctggcctgaggcttctgctcgctcctttacgccttcagccagctccccgtgtccccggaggaaggagcgggccgtggtggcgggaagccgcaggccgcagtggcttcctggctggcgggaggcggatgcggtgcggtgagaggcgcgagcagcgcttgtcccgctgctcatccccgcaggtgggacaggtgtagtctgaaaatacagcctgttgagaaaatgtatctaggtgaaagactggaagaaactatgaccatgttgaagtcagctattattttcaggatcaaacctcttcaattccagatttttgctgaagatcaactacatcatagctttaaaggaaggcttgacaggggtcatttctacaaatatttaattatacaatatactccataacctttccaagtgagaatgcagcagagtggaaaaactctttaaaccatgtggtttgcagagattgtccttgccgttattcctgaaagaagttgactctcacactgatagcctttttaaaagaccagctgataatatttggtctttactaaagaaatttaattccacacaaattctgcaatggccccagaacacaaggaatgtcaaataggatggtatagtcgctttgctaggcatccatagtgtggaaaagctggagtaaactctggagttatgttgacaaacatgacttgaatgagaaggaagtatttcaagaataatatgacaactgtgtgactacaatgaggagatatacttatgacatggcttaaaatatacaagttaaacattacatgggcgatcaagatctgttggatatcctgttttttcataatccagaaagcctttttgtctttccgtgtcaatggaagtgtcgtccagatcactgtctatatggaagcagttgccaagaagcagaagaaggaatctttatttttcacgggaacagaggtgtttaccatgatgataagcaaccagcatttagagctgtttatgaagcactgagaaattgttcttttaagatgacaatgttcattcattaataaaacctttagaattggaactacaaaaaatagtgcatacataccgtggaaaaatttactaaatatttatcaaacaattagcaaaaacataagagatcgctatgtcagatcaccaaaggaaaggtgattcttgttgcctgctacatcaaatggatgaaaagaacaaagcattggaggataagtatgaaggaactgtcttgggtgaagcattaaggcaggaattattcatctacagaatttttttttttcctgaagaggttaaatgagcagtattttcaggtaatgaagaataagttaaaatcttgggcttcaacaaagaaaaatttttggcctctgatgttgtgtaatgttacttactatcattccagtattgatgaaaatattattgaatggttttagcctgcaaacttctgttgactcatactctcaagagtggtggggctgtgaaaatgaagaaaatgtacctcaaacacagtgcaaacactcagatggtgagtagagcgataattttatgtcagcactaacctcactttaaatgtgtgagagagaagtttgtctacaggagtagaaacagttctgtttctaaagaaatgtgatgtaaccaatgtaaccatggatgatctatatctgcctttacacatttcatctctgttttaaaatatttttatgataatcatatttaaaattgtttttagattataaggaagctgcatgttaaaaattgagctgtataagaaagaggaaatatagtgaaaactttggggttttaatctgtgcatgtgagagagagtgagaaatatagtgttttcattgtgtatgcattaaactgtcttgctaaaactcagatctaagattgttaagtagatatttggggaacttttttatcactttaaatgaaaaatttcagccttactgggcattctggaagcaaaatatgttatgctgatgataaagtgagaaccttaagaatacactcatttgatggcggaaaatgtgatggaccaaaatgcagaagctatacacgtcctgtgagtagtaattttagttacaatgcagtaggaaaatgtggcgcatttaaacatttcttctacctcataatggctttgcaagatacttgtaaagaagcaaatgtctagagccttactttaagaaagttaaacaactttggtgaatgatttggattaagattgttacatccagctatagaaatgtggtttcaatagggttgatgtgagtgagtaccttccttttttgaataccacttaaaacagttaactttttaagtcttgaagatgagaaaaatattgcttatctaatataactattttaatagttatctaatttatagttatctactataactatacattctgaatacttagcatgtactgtgctggggcacatatcttattttcccagctgctaaacgattatcttccttctctccctggtattttaatgcccaagtagaaaatggaaaatcatgaaggaaaaatatcacttgtgaaaatcgtggcagttagctttatgaagacacagtggcctctgtggggacatgggatatgcagaaagagatggctagtacagttgttctgtcttctgcagttcagtcagggacatattgagagaggaaagtttaagcaggtacattagaaattgataaccagcccagcattcttagaacagatgggtttagagaacacgagttgtagttccttggcagaatgccatggtggatatgagaaactgtgaactgtgttgaaattgagcttgagcagaaaatgagaatactaaaaatttgaagttcagagggtatgcattagattatttctaatggtccccatatatgatcattgcctgcctgactatataagactcctgttgggagcttgagaacagattgctgagcttagccctttggagactctggtatgctgtgtctgggatggagtctgcaaaaaaaaatttaaagaagagacttaaaaattatacaaaactagaatagtgctttggtactatcagattacttgggggctattcccacttcgattcttcatatagaggatgtgaacagagaaacatgcagataaatcagtcaatgccaactgctgggggaaacgtccatagtctgcaggttcccacagaaaggatagcacttccgtcctctcccatgagggaaaaacaaaggagaaaagcttttggcctctcaccataagctcattcagtcctccccttgggaagagaaatgacttaactgaggaatgtgcttgaaagtagctgtactggtgaaactcagcctctgtgggtttctctctctttcagagtcagctctcttcaggatgcgcatttatttctccctttggaggaggcctcagtccagctcagccaaggactgaaaggcacatctggctaattcaagactgaggtattgggaggtccccttggccccagatctatgatatgttctcgagtcctgagacctgctgactctcgtatctcttttctcagttgggtcatatcttggggttatttgtgttcccagctctaacaggaaggttcctaagcactcatttcttcttaaccaatttctgaaggtaaaatgttggtgaagagtgctcttttcttcctgctaccattaattggtgtttattttgtgtcaggcactgttgagtattttacatttcttatccagtttgatctttacagcaactttatatgacagacattgttcccccatttttcaggctagaaatctgaggcccagtgtcccacaatggctgtgtggtgacactaggctttgagcacagatggttgacttccaaagcctatgttcctaaccattatgccactctgtgttgtgacagcgccaaacatactttcattcatatatatcttttaactgatcatgttcttgtgtgatttctttcagaaaggcttttacatcaaatattgataatgataataataatgaacacatgttgagcacttaccatgtctcaagcactgctctagagcttcccatgaaagaacccctctaatcttcagaacaaccctgtgaggtaggtgctgctattactctgttttcacaagtaaagaaactaagcacagcagatccacagtcattctgtaggatgctgtgtagaatggctcccgggacactgggaaagctcttctgcacctcagtatcttctttactggttcattaatgtctgatattcctgcatgagaaagcacaacatagacagaaagcttaatatgtatatacacacactgagagataaggcattgacataacatctcattataggtattagaaatgcagtctcaagagcaggttctcgtggggtgacaggcagggtattctaggggaaggaatatcccaagaaaggtggcattacaaaggaagaggagaaagaaagatgtaaatgaggagacactgattttcttccattgcaaagttttccaaggctggccccttttctattacattcttacccagtaactcatactttccctagagctcttgcaagaaagaactattgagaaagtagcccatctgaaagtacatttcctgctgtttatctgcttccagaactggctgaagtttactttttggttctccagagacctagcttcttccaatgtggtctatttaatctcctgtcatgtgggaaattatattcaaaatctccatgatcctctgtccatagtaagttatgcatgtagtgagaagtacatgccacaaggtcttgagattatatctgcaatgtgttgctgctggctgttgatcaagataggctgggagaagatcattttcaggtgtgaaaaactgtcacctttatcaaataattcttcttgcatatttcccaagacgttgtagcctgtctaaacttgggaggttaattttgtagcattcattatgaccgaaaatgtagttcacacaatcatgatgctctctttattaggtgttactgttaaacaatattaaaatacacacaatgtggctggtcttttgtaagctacatggcatgtttacttctttgccaggtttcttaattgcatctcttcatctttccgaataccagtgtcactgtcacccacaatatttgctgttttgagcacatggtttaccttttattttgcccaataatagaatatgatggggacatcttatctgagtgtttcatagtatgctgtagtttgaattcttggctgttggtttcccagagtcccagctcctgccactgcattctgcctttgtaaatggagaataatggctctaaaaaaaattcacctaagaatgtcatgatagtggagagggaggaccatggaaatgctaaagccacccactcggcttctgtaaatcatgcagaggatcaggaaaatgattgaaagtaacgtatcccaaacaaagcagtcagctgtacaattcaagacctgtgtctggctgtaaaaaaaaaacaaaaaacaaacaaacaaaaaacacaaacaaacaaaaaaatggaaagaataaccttgctactcatcttgttcaaaaaactggagcagattgagtatctagactcagtttcagaagaaatgttaaatattgacaggggcatattcaagatctttaggattttttggggggaggagaggggaacataaaaaagcaataataaagataaatttgaatgcaggaaaaatacacataatccatgaatctaacacctgttttcgcatgtttatcatctttgtccctatgtagatctatgttttctttcacagttgcagtcatagaatatattctattctctaagcttttatccttcaacattataggagaatgttgttccatgttaccacatagccaactgtttcaaaacttgtctagtaaattctgtgctgttgttttcacagggagaaacatgcacatgtatattacttttttttttctgttgaatcatactcttggaataaatttttttcagtgaggtttttggttccaaaaagtataaacattttggtgatctttagtaagttgtattgctttccaaagaagtgataggaattatacttgccaccccaacagtgaaagaattgcaatttaatttcaatgtaaaagaggatgctactgttgctattatattttctattataatgaaaaccgttaaagatttaaatcaagctggattgtctttcaggagctgctgttaaatgaacaccttgatactttcgttcttggagagaaatgagccaaggaggaagaccatctaaaaaaaaccactagacaatttgtgctcactggagtggtctctgctgggcaaaaggtctttagaatgactcgtggattttctggcaagtggcaaaccatacaagtgctatgtcaggccagggagacaggtgcagccctgtcagtgtcaaagaagaacactggtagcagaagagctaagagtgaatgaaaattgaattatctttatttctaggacttgtctattgagaaacaacagtgctggcaaccatttactaccaacaagaggcagttccaagagaagaatataaaatatgctctgctcaatcccacgaaactcagagtgtctcacaatggccaatttcttatttttatcctgtccagagacaaggaaggatgcatcagggagctgctagcctctgcgatgaataacttgagtcaggctgcaacatgtgaaagaattcagctggtcaggatttataacactagctggattttttgctttctttggggttcatgaagcatggtgttgtgagataccacaggagtcccagagtaaagttacatacctatttctcttccttatttttatttttttggcatgttcatactattttattaccaacatcgttggcatccctgagtatgagagttcagaagaaacttagaggctattgtctgattcaatccttgcagcttacaaaaagaaatgtggggagcagtcactgtgtgactagcctgaggtcactcaggaagttagaggcagaactgcagccagggtcacctctctttactgctactagtgtgctccttctactgcaccctgatcataaaacatctcccaacccaggaacaaggtctaccgcataggtgggcacagcagcgtgatcactctctcagtcgtctgtactcctcctttgctttgaccaaagacacaggaagggaccttttgccccacataaaacacctctcagaggcttggcaacaacaacagataatagagagcattgacctaagaccaacatttcaaccatggtgtcaaaacaatattttatttcagcaaagaaaaactatgtcacaagtggattattattactaataatcagactagtggtacttgcgaatgacttggtttcatactcacacttggacaactatgcacactgagtataactgaccttatgagaacatcattctcactaagattatgatgtgctttctcacgtgggaactgtacataatattgcgtgtacacttgggaggatgtcctgcctgtgatgttgtctttcaggggaagaagaatggttgagaactgagggtatattaaacatttactcctccagatttttcaagatttctgttaagccagatcagaagaaagccatctatttggattgcatcactctaacctggtaagtcgaattgtctacacagaattataatttcacgatatgtccagattacttaccaagagccaatttgagacaccaacaggactagtaaaacatctttgcactgtgggtagcgttgctatcaaagaccttatacattatgccattcaagaacctttatattaagatccttatggaaaatccttcccaaagtttaaccctatgataaagggtttttttctcctggtaacatagtgggcaattgggaactgtttaacccaatgcattgatttcattgattgttttggttgccgagaagtatggatgctcagaataggttttcttgttttcaactgctaattcctttatttaaattgtaataaatgtttccctttacttctttcctttttctttttaagaaatttaatgtatttcataataaattataaattatcaatagatcaattagcatagaatagtttggaataatgcttagagatctcccattgaaaaagaccccagtaccatagggttcacagctgagtgttaactgaacttgaacaaattctgattttatttaaaatgttcaaagcctagaaaaaaaactcctgcagatcacatggggcacataataactaaaaaagaaagaaacaaagaggggtggctttcttcaattaattttatagtgtaatatcaaagcttaatagttaatatatttcatctaatgtagaatgtcaatgtttagaaatcagacattatttcatgtaccattagagatatactgccaattaaactgtgacttccttagcaaaagcaaaacaaggaattttaaagatattaaaacatgtaaagaagaatataagcactatactcccaaccccttcaagtaacatgttaatattttattgcattggttttcagtaattacttttaataaaataaatcattattagctaatgttccacccctaccactccaatctcattctccttctaggtcccccaggcccaattgctaaaataaatttgttgtacactttaaagtcaattttctatacgtttgcacataaatatgtgcattcatagaaagtatttttgtgccgagaaggtagaataagcccttcaaagttgttgatgttcagattccagttggcaaaagtcttacacatgtggcattaaatattttcagtattaaacatgcacattccacaagttcagcagttctgtaatatacatccagagtctgccctgagggatgcttacaaccttagtataaactctcactcaccccttttagagaataaaacttacacctatgtaatgaccagtccaggtacaagggtgtcctctgagaacattcaggagaaagagtggtggcatcggcaggaaagtgcagtggaaaggaggagctgactttggcaggaaaaagaacgatattactttgaatttatcaactctgacgtaacatcctgataaaaagtgccatatccaaatcacgttgaagattctcaaaggacagtaccaaagttgaataaaaacacagtgcctcaaatgggaagtggtatagaaaggcctgaggctggggtatggaggcacacggtgtgccgagaacgagggaagagaagagtgaacaactgctcggggtcgggttgcattgatggcgagagatgggtgtaacatgcatttatgaggacagacatgatcaggtttaaagaaaaagaattttttctttttccagcagtcccactatggggcatttatctacaggaaaggaaatcagcatatttaggagatacctgcaccctcatgtttatagcagccactattcacagtagccaagattagaatcaacctaaatgtccaaaaacataatagattaaaaatgtagtatctattcacagtggagtactatttagccgtaaaaataatgaaatcctgtccttggctgcaacatggatcagcctggaacactacattaagtgaaataacctaggcacagaattataaatcttgcatgttctcactcatatgtgggagctaaaaaaaaacgaactgagctcatggaagtggagagtagaattctggttattacaggctggggagagcaacagggagaagaggacagggagaggttggttaacaaatacaaacttacagctagataggagtaatgagcacacctatgacaccaagctgggaatcgacaagtgtgacaactcctccacgtccctgaagatgggatacacgcagggcgctcatcagagcggccaggccttcggcatgggcctacagatatacgaccccaggtactactggggaggcccagtggcccacggcgctccctcgggctccggcccctgaatatctcccttactaccaggaggagaccggctactgaggctcccagcacgctctctccacacatgatctcccctctgggtgtttgggtttttctgtgttttcatctttttttttttaaacctgttcagtgctgccagtcaaccgagggtctgtgagtggcagcgtgggatcaggcagcagggatttttcccccacctccccctgctttggttccttctcaggactgagccaccgggctgtgggggaagggatcaaggccatatcctgatgcgtgtagggtgaaggtgcccgctggcacttccaggctgtaggctgagctgtgctggagagaagagacctggacatggagggaaccggtccctgaaggtttctggttgcctctcctcttccccttttctcagcctatcagtaagtggtttctgtacccgcaaaagtttcaggaagtattaacaaaataaaaaaaattttttttccccgaggaatggggcggggacagtggagagggtgctaggaagtgtgtcccctgggagagggggctcagccacgatgctaaaatatctcaggctcctgagcagctggatttccctaggaccctcagaccaacagacctcagacctacgctggggctccttgaggaaactgaggcccgtacaaggtagtggaattttgagttgtcagggttaagcctgacccatctccatcctgctcccccacctccgtggccctcagtagggctttttgtttgtttttgtttttttgagatgtagtctcactctgtcgcccaggctgaagcgcactggagtaatctcgcctcactgcacctcggcctaccgggctcaagcgattctcctgcctcagcctccagagtagctgggactacaggcgcccaccaccacgcctgcctaaattttttgtatttttagtagagacgggatttcaccatgttggccaggctggtttggaactctttccctcatgtgatccgcctgtttcgtcctcccaaagtgttgggatgacaggcgagagccaccgcgcccaggccctcagtaggtcttaaggagccccggccctccttctccccttccgggcctgaccaggtctactgctctatctctcccggccccaggccacgccaagtactgcacagagccctccacccaggggccctgcgctatgagataatgtgaaataccgactgtggaccaaacgcaataaaacctctgtttttaagaagaaaatgaaaagacttaaaattggcattttaagactttactatatattattaaatatatattaaatataaatgttatacaatttagcgcctctatctcccagtctctggttaggaacttaactttcctaagcctcaattagtaaacacttatggcctagccacgttgacccgcctctctcctaacatcatccagtacatttcggaagcgcatgcaaaactctcccaccttctgtttcaacagatatgtcaactgatacaattatacaataattgcataatatcagatttaatctcacaatcacactcagcttgattactaacccttctcctacaccttgctcacctaaatttatctacattttctatgaattgaaatagcttagaaatgtatgttgtctgtgtattatagtgtaagttattgtaatatagaaatatggactttctttaactcccatttgctgcctaggaaataccaatattttctaagcatggcaagtgtttccaagcattcagaagtggagagtgtaggaaatccactgcagaatgaggtctgctcgtcatcctctcagtctcaactgctctccctccttcatctctctctgtttcattggtgagtatagaagatcaggcatttttatatgaaatgaaaattgatggaactaaggtgttgatttgaatatccaaccgaccttttattgagtgtctattacaagttaaattgtgttgtagagaacagctcaggaaacgaatgcttgacattgatgtacataacagaaatacaaacatgccattaaaaaatcagacctcttatgagcatccagattctcacgtaagttttgtgaagctctttcaaaatgagaatgtaaaatttcaaaaaaaacatcattttcacaagtcattcttgagacagaaaagtggaaatagaagttcatatatggttgtttcactatctctaatcttatgtacagtttttagtcagttgacagccatataattcttagttttatatactgatagtcattagaaattacaaattttaaaaaatattcatgtctcattctacgaatcaatgtaaaaatttcattcacttggttatatttcttcattttacctggccttgactacttctttcctgcccagcattaaatttaattaatgtctaatttgtttacttggtttagttattttggccatgttcagtacacttgttatgaagcaggcatgtaggaatgttgacaagtttatggtcctcactcttccaaatccctaatggcggcaccccaacagacacataccacaatgtaaacacatacacacacacacaatccgtgcccacccatactcacccacgtacacacagacacacacacacactccagtggatcaacacataaaacactccacaggcaggcatcgtacagcagggatctcttagtgcactacacacttctgtaaattatcaggactcttcaattgaggtgagtctacagagatttcaaaagctatttgagtgttaagctatctaactagtggttggacactatttaaataatgcattaaacacaactcttgaggctctgaagaatttctgtgctttccaattcaccaggagttacaaggtcctgaaaaccacaactgtgttacatcctttaatagataaagcaaagctgattttaatgtgaatatactttatagttatttctattcctgttaatttttgtttgcttgtaatacacatttttatgtaactgggagtaaggaacatcttaggaaaaagaaaacaaaaaataaaatttcgctgtttacactgtgccttggtccagtaaccctgcactgcacatatacactttaaattggtgccttggggaaccacttcggtatttcttttttttttcttttatgttgtaaacctttcttgtaaaaataaacaaaaaacaaaaaaaagacaaacaaacacattagactatgtcaacatgaggtcaggataatcaatattactgtctgaacctccacatcttgtcccactgaaaaggcttcagagataattacactcatggagttgttatttcctatggtaatgatgcttctttctgtaatacttcctgaaagatttgcttgaggctattgtacagatttaactgtttttccataagtagaaggggtaattctaatgataaaaattgtagtatataaaacaaataaaccagtaacagagtttatcattatctaatactatgtactgcacacaattgtatgtgtactttagtatcactgaaagaagagcaaatttgtttacaccatcatcaccacaaacagtagcaatacattttgctacaatgttaggtggcttacaatatcactggatgatagaaatttttcagggccattagactcttatgaggtcaacatcatacatatatggtctgtcattgaccaaaacataattatgtggcacatgagtgtatatatcagatacatcaatcaatatattcaacatttctcccctgcttatcctaatgataaagatgatataaaatgtaatttaaaaatataagaagaaatggtgtaatggtctctatattaaaaactagagttaaattgtttaaaaaattataagtagatgctaaatacacagattgaaatacattaaatacattaagaatgtttgttctgtttcttatatattgctggttttctgtcattgaaagtttaatttagacctccttatttcatgtaatcaccccaataatttgtcttacaaacaattaacagaagttaacactatataacatagttgtatattgtcttactcttacaatgggatactttacttttcatgagggaaacagtaagctataaagtttacacaatctgagatgtagataaagattgatgtgcaagattgcttctagatatatcactttataatggtaacataaaaaaaggaaagtaatgtgtaaaatatcttctaatgcaaccctttccactcttcctgactcattggccttttttttttttttgacttctcaggaatacattaggaggctccctcatcctctggcttcaggttaggttcagcctgtggagaaccctgtaagaaggcagaaaggaagaggagaaaagggtcatggtgtttattctgttggtctcttccccatgaggctgtcttccctacatgtgtctctttacagaaggtcacttttgttctccaggtggtctgatcttctactccttctttttccatgttttgtttttatcctcactgagcgccagttccagatttattgcttacaattctttcatgctccttcctttgtatggaagcattcctcaaattattcttagttgtatttaccaactgttttctgttgaaattctgactaatccagaatataaaactttttagagtccagtcattctttgccatgttctgtttccccccatctctgtggctatgaaaacatgtatcaaatattttacctgactcgcaggaaggggaagtcccactgctttgcctgttttggataggtagcatcagttaaactaaacctttcataaactactgatacatcagtggtttcttgttacatagaatgaacagtattcaccagaataacatcctgactagcaaacacatcaattgccactcgatgttctaagtgttatgagtaaaataaaaactgaataaagattttgccctcaggatgtttatgttctcctacgtgagaaagataattaaaaatacaaaatataatatcaatttttgaatcataagtgttacgcagaaagtgaattagggtaaatttccatgcttgtagttttgcttatggtttactatttgtattcattttttaggactgtcatacaaaataccacaaactgggtagcttaaaacatcaaaagcttattctctcagttttggaggtcagaaattcaaaatcaagatgttagcaataccatgctccctctgaaacctgaaggagagaatccttctttacctcttgtcttcaggtgccagttatcaattcttggcacattttttggcaggcaactgcatcagtttgtgactctgtcatcacaggacattctccctatatgtatgtatctctgtgcccaattcttataaggacagcactcacctgacctcatcttaactagtgacatctgcaatagctctattatcaaataagttcacattttaaggtactggagtttagcacttcattgtatcttttgaacagacacaattaagctcatatgtaataaatattagtattcaaattaagtatatcctacacttaaaatatactgataaaataatttgtaatttctaaagacctcataatcatacaatcaatatttataacagatttctcttcattttgttatctataaatctgtatttttgtttttagttacaaccatgacatccccagaaagcttttctatacagagaagtggctctgaaactgttatcaacatctaaacttttgtaaaaattgaaactattgtaatttcaatttacctgaagaatgttttcttttgatgtatttgaactgagtatccctgtgattgacaggatgaaatgtttatgaaatagatcaatattgctcattgtgatattcatcattgaataattatatttttattttgtcaattctgagttatttggaaacaaaaatccacagaatgttaccttatataaatatgttaatacattcttgattattaataaatctgttactacaatgtcatatcctctcagtaataaaagcatatttaatttatgcttttatccattagaaaacagtgaagctagaaattatttaaaattttcccctaagaaatatgtggaaaaaataagaaaatttatattttaaaatgaaattgcattaagaagccaacattgatgcatttattgactaaagaccagagtttacattagggttcactctttgtattatacagttccatgggttttgctaaatgcatgatgtcatgtatccaccattacagaatcatagataataatttcactgccctaaaaattccctgtgctccacctacttatcccccacatgcccaactcctggtaatgactaaactttgcactagctctatagtttcgccttttctagaagattatatacttggactcatacaatatgtagacttttcagactggcttctttcacatagaaatatgcattcaaatttcctccatgtctaatcatgactggatggcttatttttttacccctgataattatgtcattgtatggatatagcagagtttgtttatctaattaaggaatgattacctattaaaggataagctgggtgcttctaagttttagtaagtaagaatatagctgcacatgcaataaacatttgcatgcaagtttctgtgtggtacagtataccatttctttgttcttaaatacttttcactggtgtgaaccaatgagatgctaacattgcattgctcgtacttggttggtttctaaactttacttacttttacaatttttaaagagaagtttctattgccagttttttaaagtgatatgctctgctggccttgacataacaatacaccatcattagcttttaagtccttaatatgctcaaaaaattagagagcaactatatccatgaaccaccatctagattgcaggaattaaagggagaacaaatgttcattgaatagatgcaatttaccaggacttatgctaagcattacagatctataatctctttttatatatatatatatatatatatatatatatatatacacacacacacacacacacacacacacacacacacacatatatataagaaaattaaggtgagaaagtaataaacaatgctaattagctctgtttttaaaagtaacaatccaaacttaaactcaaattatttttactgtaaaaccactgtagaaaaataaaaacaattaaattcagagttctatattgcatactaactgtaaaccacatcattgttcagattgatttttttaacagatcaaaacatatttaatccgttgcattgaatttaatgcattgtgttgctactccttattttattttgttttattttactcaattttatattttattttctttctagtagaatattagcaggtacatctgaataccagaatgtaaagaaaggaagaacagatccaaataaatatttaaagtaataatggctaagaattttccaaaattaacagcagatactgaatacagattcaagaagtgcagagaataccaagcagaataaatgtcaaaaatctatacttaggtatatattttttaaaccaaagaaaatcaaagacagagagacatactgaaaggagccaagggtaaacaagaaaacttacctgtaaataaataaggctaagaattacagttggtttttcattagatgaaagcaagaagagagtggggggaaatacttaaagtgttgaaagtgaaacacacagagacacacacaccatctacatttcttttctttttttttttttttggagactggagtgcagtggtgtaatcttggctcactgcaacccccacctcctgggcaagcaatttctcctgcctcagcctcccgagtagctaggactacaggtgcatgccatcacacctggctaattagttttgcatttttagtagagacgggatttcactgtattagccaggatggtctcaatctcctgacctcgtgatctgctcgcctcggcctcccaaagtgctgggattacaggtgtgagccatcgcatctggcctacatttctatatctaatagaattatcctgcaatagtgtagaagaaataaagaccttctcagacaaacaaaaactgagaaagtttatggtcagtagacatgccttgcaaggaatgttcaaagaagttcctagggagaagaaaaagggtataggtcagaaattggtctatataaagaaaggaagaatatcatagaaggaatgaatgaaactaaaataaaatgttttattttcttattcttaattgacctaaaagataatattttgtttaaaaggaataactgtaacaatgtattgaatgaatatagtatataaatgaatacattaaatggcagtagtgtcataaataatggtaggaattgggattacttgtatcttagtttgctcaggcttttataacaggataccatacactaggtggcttataatcaacaaaaatgcagttttcagttctgagactgggaagtccaaggtcaagccatgtgcatattaagtgtctggcaagggcttgttcatagaggatgggtcactgggatttcacacggcagaagagcaaattagctctctagggtttcttttgtaaaggcactaattctatccataacagtttgccctcatgacctaatcacttcccacagacccatctccaaatactcttaccatagggattaggtttcaacatacacattttgggggaataggggaatacaaatattgagtctgtaacactcttgtaaagtgatatttgtgttgagttattcaaagtcttatttaaaggtagattgagattagttaaaaatgtgtattgcaaactcacataaatcactaaaactgttctaaagtataactgacatgctaggagaggaaatgtaatgggattattttaagtgtcaattaaaacaatagaaataagaaaaagagtgattgttgggaggcaaagaataaatgatatgaatagaaaatagttataaacataataaataccagcccaacttttttaccacccaataattactttaaatgtgcatgatctaaatataccaatttacaagacagccattgtcagagaaaaacaaaataagacatctagttaacaatctttttctttctttatttaataaacctgaacaacattttacatctaatttaatcccagcactttgggaggcggaggcgggcagatcacgaggtcaggagatcgagaccatcctggctaacacggtgaaaccccgtctctactaaaaatacaaaaaaattagccgggcgtggtggcgggcacctgtagtcccagctactcggagaggctgagacaggagaatggcgtgaacccgggagacggaggtttcagtgagccgagatcgcgccactgcactccagcctgggcaacagagcgagactccgtctcaaaaaaaaaaaagaaaagttgatgagtaatttttgtcatatggagttcagtgatatttataataaaaattgcataccacacaactgatcaaagcacagcatatccgtgccaccgtagtcttacttatggctacctgtccagagctcactttgaaaagtcacttccctactgaaattcatgacacttatggaattgtcagaatctataaagaatgtataaggaatttttataaattatgaattactctaagtaagatattttgttaaagcagcaggaatgtcctaaaacaccatgtgatgggaacaagaaatgacatccttagtcataagcaaaacttgttgatgaaatggctaaaaaataaatatgcccaactcagcatcattaacaagggaaatctcataggtgataaggaacagaacctggccctaaggtttctaatagggccaaagtctcccacttcatgttttactcctttgggtgtctctatgcagtaaactcactagtttaggtactagggaacagttggtttagaaaggtcatgccaaaaggtcaatataaatttcttcactggccttcttttagagtaatgagacctttctgtaaaataaagatggttttgttgcatatccatacagcaacctatcatttataggagctattctttctgcaacatccatattaatacccagatgaaaagtgaaccaaaataaaaataagataaaaagatgaatgaattttttttcttaatttgggcaaaattacttcaaaatgtttacagtatatacaacatctcaaaatatgtaattggaaagaaaattttacaaactaaaaatatttacattgtgcatgttttgtttttttatttagaaataaaagccaaacaggtacccagagaagccaaatacaagataataattactttgaacactttttcattcaagcaaatttctaactgtgaatgtagggttacaagtacattccagaaagtgaaggtacattcggtctactaaatttcttggccatgattttctaaattttactgaacttggaatcacaggactggggaatattcattggggaatataaaaagtagctttctcatttttgcagtgatttcatataaaagaagaaacattatttatataaaatattttcttcacatgaaaatttggttggtatatctgtgctattttaccttttgctagatatatgttaataacttcagaaaatataatacgtgacacattttgatttatcttctgtcttcatatatcccaaagcttgatttaaaatgaagataaatcataaaacactcaatgattttgtatgttatattcaaaataaggccacattgatccaaaatcactctgtagtattcagttacttagaggagcatgttaaagttttcatacccatataggataatcaattgtaagaatttctgtcatttgcctcaatggtggtaacaatgtttatttattagtagaataaagagaatttatttccaagaaatgcaagagttttatgtattttgcatttaaaaattaagtacagttcaatgagtgttttgatttaaaaaaataaaaatgaacagaattttaaactacacttatgatgtagccatgtggccaaaatactaacaatctgacttaaaatatatcttcatctaattattccttctgtgcaaaagatgaattggatttgttgggaaggatgctttgaaagcatgaatttaattttccttcttccagggtatctatttcttccatcattgtaagtaggaattgcttactcacatgcaaaaatgcaaacactggtttttaagtgctatctggaagaaatactagaatacatatattctacatacatataatatttacaatacatattcaagatatctatagatacataaaaataaacatttaatgaaaattgaaaatattagaaaggcctaaggtacttcaggtaggtaatctcatttatttttacaggaaaaggatatttcccaataacattaaagcttatataaaatttgataattggttaagtcaagcttctaataagtggtaaataaagatttacttgttagtatccattatatgagtattagttcattctcacactgccatgaagacatacgcaagactggagactgagtaatctataaagaaaataggtttaattgactcacagttctggggaggcctcagaaaacttacaatcatggcagaatgcaagagaagcaggtaccttcttcacagggtggcaagactcaatgagtgcaaccaggggaaatgtcagatgcttataaaaccatcaaatctcaagataactcgctcactataatgagaacagcatgggggaaaccaccttcatgatctacttacttccatctggtcctgctcttgacacatgaggattatggagattacaattcaaggtgatatttgggtggggacacagagccaaaccctacagtatgtatggtatcctactatgtattgcttgaatctacacaatacagttctgtctcttcaaatggattccagctgaggatagtaaggaacaaaattgacacataatatgtagaaaataatgtatcaacaaaatgtattatataataattttcttcattaaataatattttttagtaagaattatgttaggtgctgtaggaataagagaataaaacaagtgtgtattttactctttggagaaaagtaatacaaaaaagaaagccaaaacaaagcagaatcaaagttggaccttcatatagatatgcatgtaaatatatatgcatttgtggactttcaaaaaatttaaaaacatttttattagagaaatgataaaactttatgataaaattgcattcaatttggatttagaaagggtaaaattatgtgtcttagaccattttgtgcttctaaaacagaataccatagattgagtaatttataaagaacagaaatttacttcttaccattctggtggctaggaagtccaagatcaagataccaggctctgaggtcttcttgatgcatcctcacatggtggaaggtggaaggggcaagagagaaccaactctctctgtcaagaccctttataagatcacctcatcccattcatgagagaggatctctcatggcctaaacacctcttaaaggcctgacctcttaggactatcacattggcaacacttgaattttggaggagattcattaaagccatgtcagtatccatttcttactaaaggtaaaaaataatttgaagtatgaagggaacacaaaatgaataatacctccaagaaatattcattcatttgtccactcactcactaaataaatattgagagactgacttgtaaaagctaatttactctcttctaagctccatcataccaggctgggaaactcccagtagataatatgggcactaagatccaacctaatataaactcagatcaatttacttcagatatcaggataaaaagttctgcaccattgtgagccagggttcttccagacagcagtacaaggaagtagaagagacagagttgatccaaaaagcaatgagcctgggaagtttttatagcaggtaatttcaaataaatcattttctatacaactgagattcttctattcatgaatagaaccttcttaaatgcactccagcatttctccaaagtggggcattgtaaacaaataaaaagagggccagaaatggctatttatctcacttaagtgtaatagagcatccaataccagcatccaggctgggtcaatggaaatctggttccagactttgcttttgcctttgaagataattttttttttctttaaactgtatttgaagtgagattctatatggactgctatgtaagggaagggattctttgaaaatgggtccaacccactagaagaagagataacaaatggagataagctgaaccctgattactttacttggagcctgaaatcacctttagcttaaatcatactacccttgggcttagttactttagtctactttttttttccatttatgttacttgcccccaaatgagtcttaatggggacaaatggtcattcaggtacaggcctcagaagagcattcctgatgagaggaaacatttccaaggaatgttaatgagattgttctgggacaggataaataaaagaaatacatttagaggagttctacatttaaggaacagcacagaaagagaaacgtacaaaacagctagtggtggaacagtaatagaatgaaagggaaaaccaatttctttgaaacgtttacagtcatgccccacataataatgctttggtcaatgacagactgcatttaaaatagtggtcccataagattctaatggagctgaaaaatatcttccatgtagtgacataatagccattataacttcaaagctcaatgcattactcaagtgcatttggtgatgctgatataaacaaacctatcgtgctgccaatcatagacaagaatagtgcatataattatgtacaacacataatacttgataatgataataaattactatgttactcatttatgtatatactttactatttaatgttatcttagggtatactcttatttattaaaaaaaattatctgtaagactgtctcaggcaggtccttcaggagatattttagaagaaggcattgttatcacagcagactacaggtccatgcatgttattgcccctgaagaccttccagtgggatgaggtgtgaaggtaaaacacaattatatcgatgatcctgatcgtgtgtaggcctaggctaatgtgtgtgtttgcattttactttttaacaaaaaggtgtacaaagctgaaaaaggaaaaaatcttataaaacagagctataaaagatgatatttttgtatagctgcacaatgtgtttgtgttttaagctaaatgttattataaaaaatcaaagcgttgaaacatataaaagcgttaaaatatattagattaaaaggtatagtaagataatgttaatttcatggtccttaagtgtatcatttttataaaatccacagtcatatacggtaatgtcctagggtttcacattcactcgccattcactcactgacttatccagagtaacttttagtcttcaagctccatttatggtaagttcccaatatagacgtaacattttccatcttttacgctgtacttttactatacctactctatgtttagatacgtttaaatacacaaatacttgccgttatgttacaattgcctacatgttcagtatagtcacacgctgtacaggtgtgtagcctaggagcaataggctatatctcatatagcctagatatgtagcagactatgttgtcaaggttttgtaaacatctatgatgtttgcataatgacaaaattgcctaataatgcatttctcagatcatatcagtattactgtcacatgattatacatatttaatttctactggtgaaatattattattcatattgaacagaattgaaactctagctctattacttatctctcctagttgaagccaagctttttccaacagattggaaaactatatgctactgagaaagttactgctattggagttctaaaatacatacgtatgtctcttagctctcaaaattattttgtaatatcatatgcccaaatacaaaaatataagtgcccaaatatttagacttgtatagtcaatgagtataattaagtcttgacactaagtaatattcaaagagggaagtttgctctttattttcctaattgccatgggcaaccatcagttatttatttcatttcctttcaatagttcttgctctcagcaagtcgggatctctcagagagaaagattcatagaggcctgagaaaaacagaagaatctagggacaaatgtaaaaccatcttcctaattacaatccatttattagatacaccatcctaaattttgtcctaaagaataagcagggctcatattctatttcttatattttttgagggacgatttcagtgtaagcaacaaagcagtggaaataatttcaaatgctagaatagttttttgagtaaaatctggtcctactaatgatttaagagctggaacacaacttcttgcagatctagagctggatcctagtccaagtgttcctggaagggatggggtaagggtgaatggagtgtgggaatgcagtcctgctgagtatgggcagctgttctggagccaagcaattcacagtttcactttgccaaaataaatccacttgaatgatttttttttcagggatgaaactgagaaattggtggtgagtagttctgcttaggaaaatttttgacatttcaggataaatgacaaatattacactttttctgagactatcttaaaaattcatttatatatctaattctcattattttgctaaactttctatacttgctattcacttattcacatttaaatttttattgtgacaattatataaatggaaatagctgtatcttttaagtatagaatccctatatttttcttcttgctagccatatctatcttatttatagtgagtatccacctttcatgaattctgaaagtgttcaatgacctcagaaagcaatacaattgtgtggtatacagaatattagatggtcataaccttagcctcccagtgttactttgatgattatattgtattacatggcaaaatggattgcgcagatgtaattaatgttaataatcagttgatgtgaagacaggaagattatccaagtgtacctaatctaatacaatgagctctgtaaaattttatttatttttgcccgactgtcttatttctgagagccagttttcaagctctgaggtcctttcctcaacttggtccattctgttgttaatacttgtgattgcattatgaaattcttgtggtgtgttttccaactctagccagtcaatttggttctgttttatactggctatttcaccgatcagcacctgaattattttttgtgtttgttccttagtgatatggtttggctctgtgttcccattcaaatcttatctggaactgtaatccccatgtgttgagagaggaacctggtgggaggtgattggatcatgggggtggttcccccgtgctgttctcatgatagtgagtgagttctcatgagatctgatggtttaaaagtgactgtcccccttcactctctctctcttctgccaccctgtgaagaagttacttgcttctccttcaccttcagctatgattataagttttctgaggcctccccagcaattcagaactatgagtcaattaaatctttttcctttataaattacccagtctcagaagttctttatagcagggtgataacagactaatacacttagcttccttgaattaggtttcgatgttcccctgaatttcaatgatctttgttcctatctatattctgaaatcaatttatgtcatttcagccatctcagcctagttaagaacccttgctggggaactagtgtgatctttgggaggaaagaagacatgctggtcttttgagttgccagagatcttgcataggttctttctcatctgtgtgtgtgtgtgtgtgtgggtgttcctttaattgcagtgtaaattgagtacagtcagtagacttctttccatgttttcagagtcctaaggctttgtttagggcctttatttgtagctaaattcttgtctttcttttcacagcagggtatgatagcaaagtattattggtgttgaagttttggggtgtgatctagtagctggtgctgaagtgtaatggtcactgtgtaggctcctgctcagtcatgtggctcctccgtatttcctcatgggttgcagctatgcttcctctcaatgttttgaaagtcagtgtaggctcctctcccacttgagtgctcactgcagatcttggcttggtgcatccaggctgcacaccatagttctgaaatgatcataggctttatgttacttccccagcttggaagcagcagaggagaccctgtggctcaacgtcttttcttgtcacttggggctccattgcagaaagatgcagaactgcaatcaattagcatgatcagcctgacatggggcagctgcactgtgagcccacgctggggggatcctgtctggtgactagcagagaatgtgggtaggacccgtgggagacagactggcctcctctcattagagcaactacaacttgcgggataaagcactcggagtctttgctccttccctagttcaagggtaaacagggaagttaaactggagaggcagtggcagagggacttttggttgcccctgggagctccatctctgagaaatgtggagctgctgctactgggagtgttcagccagagggtgaagcagctgcactgcttgcctgagctagaggctctgcttgttggggaacagggggtcaagggcccatagcagcaagaaatggggcttttctctaaatggtggctgtggtgtgctgtacgcatggggagaaagcaaccaacttagaaaacatatttcaggatatcatctatgaaaacttcgtcaacctctctagaaaggccaacattcaaattcaaagaatatagagaacctttacaggatgctaaaaaagaagtccatccccaagacacataatcatcagattctccaaggccaaaatgaatgaaaaagtgataaagtaagctaacgaaaaaaggcagatcacctacaaggggcaccccatcaggctaaaagcagaaatttcagcagaaatcctacaagccagaagagattgggggtctatattcaacattattaaagaaaaaaaatcttcatccaagaatttcagatggagccaaactaagcttcataagtgaaggagaaataagatcttttcaaacaaacacattcagagggaattcattaccaccagactgccttacaagagttcctgaaaggagtagtaaatatggaaaggaaagactgttatcagccactacaaaaacacctttaagtacacagaccagtgacactataaagcaaccacacaaaccagtctgcataataatcagctaagaacaggatgagaggatcaaatccacatatatcaataataactttgaatgtaaatggcctaaatgcctcaaagaaaaggcagagtggcaagctggataaagaaaaagacccaatggtatactgaatttaagagccccatcctacatgcaaggacacccataggctcaaaatgaatggatggaaaaaaaatctaccatgcgaaaggagaacataaaaaagcagaggtggcaatcctaatttcagacaaaacacactttgaaccaacaaaactcaacaaacacaaggaaggtcattacataatggtaaaaggttgaattaaacaaaaagacctaattatcctaaatatacatgcacccaacacaggagcacatagatttgtaaaacaagttcttagagacctacaaagagacttagatttctacaaaataatagtggaagacttcaacaccctactaacagtattagacagatcattaaggaagaaaattaatgaagatattcagaacttgaactcaatacttgatcaaatggacctaatagacttctacagaacgctctatccaaaaatgacaaaatatactttcttctcattaccacatgacacatactgtaaaatggaacacacaatcagacataaaccaatcttcagcaaatttaaaaaaaaaacactgaaatcatacaaacgacactctcagacaacagtgcaataaaaaatgtggcacatatacaccatggaatactatgcagccataaaaaataatgaggtcatgtcctttgtagggacatggatgaaattggaaatcgtcattctcagtaaactattgcaaggacaaaaacccaaacaccgcatgttctcactcatagatgggaattgaacaatgagaactcatggacacaggaaggggaacatcacgcactggggcctgttgtggggcagggggagggggcagggatagcattaggagatatacctaatgctaaatgacgagttaatgggtgcagcacaccagcatggcacatgtatacatatgtaactaacctgcacattgtgcacatgtaccctattattattaaagtataataataataataaaaaaacaaaaaaaaaccagtgcaataaaaacagaattcagtacaaagaaaatcactcaaaaccatacaattacatggaaattaaacaacctgctcctaagtgacttttgggtgaacaataaaattaaggaagaaatcaagacattctttgaaaataacaaaaagataaaacaagcaagaatctctgggacacagctaaagtggtattcagagggatatttgtagtcctaaatgctcacatcaaaatgatagatatcaaactaaaaacccagcattacaactagaagtaccagaggagcaaaagcaaacaaacctcaaaactagcagaagaaaagaaataacaaaaatcagagctgatatgaaggcgttcgagacataaaaaaaaaaaataaaaagatgaacaaatccaagagttggatcattgaaaaaatcaataaatagatatatggatacctagacttttaagaaaaggagaagctccaaataaatactatcagaaatgacaaagaagatgttaccactgatcccacagaaaaaaaaaataaccaccgtaaactactttaaacacctctatgtacacaaactagaaaatgtaggaaaaattgataaattcctggacacatacatccacccaagatggaagcaggaagaaattgatccttgaacagaccaataatgagcttcaaaactgaatcagtaataaatagcctaccaaaaaaaaatgccaaggactagatggattcacagctgaattctagtagatattcaaagaatagccggtacaaatcctaccgaaactattctaaaaaattgaagaagagggactcctctcaatctcattctatgagactagcatcatcctctatgagaccagcatcatcttcatacgaaaacctggcagagaaacagcaaaataaaaaataaaataaaaaaataaaaaaaaacttcagaccaatatccttgatgaacatagatgcaacaatcctcaacaaaatactagcgaacagaatgcagcaggacatcaaaaagctaattcatcatgatcaagtagaccttatcccaaagacgaaaggttggttcaatatatgcaaatcaataaatgtgattaatcatgtaaactaaagacaaaaaccacatgattatctcaatagatgcataaaaagcaaaaaccacatgattatcacaatagatgcattcaacactgctacatgttaaataaccttcaataaatttaggcattcaaatgaccacactgcccaaagcaatttacagattcaatgctattgctatagaactaccaacaacattcttcacagaactagaaaaaaactatttttaaaattcacctagccctcaaaaaagaccctggatagccaagggaatcttaagcaaaaagaacaaaactgaagccatcacattatatgacttcaaactcttctacagggccacagtaacccaagtagcataacactagtacaaaaacagacacgtagaacaatggaacagaatagagagcccagaaataatgccacacatctacagccatctaattttcaacaaaaccaacaaaaacaagcaataaagaaagaagttcccattcaataagtggtgatgggatatctgattagtcatatgcaagaagattgaaactggactccttctttataccatatataaaaatcaactcatcatgaattaaatacttaaatgtgaaacccaaaactataaaaactctggaagatatcctaggaaatgccattctggatataggaactggcaaagattccatgatgaacgtgctaaaagcaatcgcaacaaaagcaaaaactgacaaatgggatctaatgaaactaaagagtttctgcactgcaaaagaaattgtcagcagagtaaacagacaacctaaagaatgggggaaaatttttgcgaagtagccttctgaaaaaagtctagtatctagaatctataaggaacttaaaccaattaacaagccaaaaaataaaaataaaaacaaactaattaaaaagtggataaaggacatgcacagacacttttcaaaagaagacatacatgctgccaacgagcatatgtaaaaaccttaacatccactcattagataaatgcaaatcaaaaccacagcaagataccatttcacacctgtcagaatggctattattaaaaaatcagaaagcaacagattttggcaatgtggtggagaaaagggaacacttacacactgctggtgggtgtgtaaattagttcagctattgtggaacgcagtgtagtgattcctcagagaactaaaaacacaattaccatttgacccaacaccattactggatatatattcaaaagaaaacaaattgttctaccataaagatacatgcacacatatgtccattgcagcactattcaaaataacaaatacatggatcaacctaaaggcccatcaacagtatattggataaggaaaatgtggtacatatacaccacggaatatatgcagccataaaaagaatggaatcatgtcctttgcagcaagatggatggaactggagaccattattcttagcaaactaatgcgggaacagaaaaccaaagactgcatgttctcacttataagtgggagctaaataaggagaacacgtggacagaaacaaccaacaatggggcctactagaaggtggaaggcaggagagagaggatttagaaagaatacatactgggtactatgcttagtacctggatgatgaaatgttctatataccacagcctcgtgacacgagtttacctatataacaaatctgcacatgtaccactgaacctgaaataaaagttaaaagaaggaaaaaaggagtcttacctggcttgcagcccgagaagtcaaagtgatttgaatcacaagaagggttcagtgtattgttgctgcctttgaagacagaaaggggccacatgcaagaaccaaagggtgtcttctagcagcttgtgcaatcccaagtggacatccagaggaaatgtgagcctcagtgctacaatcacaagaaactgaattcttccaacaacctgaatgagcttagaggtgacttttcccctagtttccagataaaaacttaaagttagccatatcttcagtatcaccctgtgagttcctaagtaaaaaaaccggtggagtctgcctggacttttgatgtacaaaactgttagaaaataattgagtttaatgttaagtaaaaaatatgagaaatcaaacctacgtaataattttgttaatttctacaagtctttcaaatcaaataggtaggatttttaaattatatattttgttgtaaggttgtgtattattctctatataaataaattcaaattttaaactttattccaagggttggtaaaaacatatattattatattgtgaaaaatgattataatttcagttatagttctcagttgtggttttatattttctttcgtatttttcttgcgtgttttctgtgtggttttcaagtgtttttaaagttttcctccatcctggattttctttctctcaatccatgtatcctccaactttttcaaatatccccatcaaattgcctccctctccacttactaatatactcctttcaacttttcagttgtttcacacttttgtttttagttcatattttagtgttttagtttatttatattttatcttcctaaataaaaaagttcttcctggagcatttattgacattctcaaaggatgaaccacttctatagagcttaaccaacacatttacttacagttatattcccatattatcaaaactttatactactctaaacttctttttctgtaagcaaaagccaattggtaactataatttgaattttcatgtaaaatgacttgtacaattgttttgtgcaaatgttattttcctttttcgtgttgaacaatgggaccaaaacataaaaacaaccaaatggcaaacatttctttgacatatttactctgtaagtgggctataaagaggtctcataaaattattttttctttaaaaaaatccttcttttctgtatcttccatttgatattaaaatataacattaagctacttttttttttttagatgaaatctcactctgtatccaggctggggtgcagtggcacaatctcggctcactgcaacctcagactccactccctagttcaagtgattctcctgcttcagcctccacagtagtggggattacaggctcgtgccaccgtgcccgactaatttttgtattttgagttgggatggggtttcaccatgttggccaggctggtctcgaactcccaacctcgtgatatgcccgccttggcctcccaaagtgctgggattacaggcgtgagccatcgcgaccggccttgtgcctgttttacctgttattgcttacattctgttctctttactatttaattctattccatttacatagactcaatgcctaaattttatttaactttgaatcataattttctttaattatcctaaattttctctgctttccttcttgacttattccttctggtacttcatttcaattactaaaatttacttggttggttattgttaaccgaacttctaattcaatataaagtagttcaaaattatgagtctttatttttcaaaaggttttcttttccagtcatcatctagtaatatgtgattttaaaatttcattaaatttagtctatcttttaattatcttggtttaatgaaggattgttttagatatatgtatttcttcctcaatttccttccttgatactactgcattgctttgtgcatgtgcccagctgtatttcttggtatataattttttgagaagtgtgatgtagtaacacttctacacttctacatatttcttttacttctagtaaaagaaataatattcatgaaaggattttagaaaaactttaaaaataggtaatttaaatagaggtttcagcagcatgctgatgctcctcagtaagaactagatggcatacataaagtcaaaagaggtttgactttgacttcaaaaacaattcaactagatagaaaggaaataataggtaatttaaaaattactatagccatcccacctaaattgaaatgcagaaatatgtagaattagaaagtaaagtatttatcaaaatataacggttgatccaaattattgcttttcttgtcagaaatattcaggaactaggaaataatagtcattactttcccaagtcagttattctttatgttcataagtaattgcttatttgctatagccaatactcatggaagcctttgtcttctgtgacatagcaggtttacagttctgcttcaaatttttgaagttttcactgttacattcactggctcattttatttcatgattttgagtctgggagacattcccttggctcagtgttttcatctattgtaaattcacttcactcacaatttgcaccttttcttcatttttcattataataaataacagtttctttggtttggaaatctacagtcaaccttaagtttacattcatattattttaatttgtctctatttcattcctgctctcataacccttacctaatcaatgtctaaattgtgaagaataagcattgtagtgacaaatgtcatgcttgtctacatttctttagacaatatctttttatttatttttctttctttttttttttttttgagatggagtctcgctctattgcccaggttggagtgcagtggcgcgatcttggctcactgtaagctctgctaggtgcagtggctcacgcctgtaatcccagcactttgggaagctgaggcgggtggatcacgaggtcaggagatcgagaccgtcctggctaacacggtgaaaccccatctctactaaaaatacaaaaaattagccgggcgtggtggcaggcacctgtagtcccagctactcaggaggctgaggcaggagaatcgacaatatctttttaaaacataattatttgattcctgaattgccaaatcccagtctgttttttagtccttttcttattgctttctaaggcataataaatgtaactactgggagaaatgtatcaatgtcatctttgaaaatttttaactatctaaatttggtgaaatgataagatatggatatatgtattaaaatattcgcttgagcaatgactcagtacttcagaaacaagtagcaggctttaaaacctgaggaaaaattaggcttgtgtcacaacacaaaccacaagaaatccaaaaacagtaagggtgactgtgcaaggaggacagaaaagaagtactaaaccactttaacactatcttacatttatcagaaataacagaaattatacatatatgctctacagaattttaaacaaagaaacaaaatgtggtgcttttctccagatgttttggccagaggacataatctgaatgatttaaattccttgaaattgactgtgacttgctatacagccagcatatggttgttttattttgtaaaatatcctatatgctcttgaaaataatgtgccttctgtttctaagccaattcggttaagtcaaaacaaaattctaactataagataataataaccgagaataaatagtcacctgcagaggaccaaagcattctatcaaacttttactgcaactggattgcaagaaggtaatggcatattaaaaaagaacccagaaataaacccaaatacctaacagccaactgatctttgactaagcaaacaataacacaaagtggggaaaagacaccctattcaacaaattgtgctggaatagttggctagctacacgtaggaaatgaaacgggatcctcgtctctcaccttctgcaaaaatcaactcaaaatggattaagaaattaaatctggctgggcgctgtggctcacgcctgtaatctcagcacttcgggaggctgagacatgcagatcacctaaggtcaagagttcaagacctgcctggccaacatggcaaaaccccatctctactaaaaaaatacagaagtaaaccaggtgtggtggcatgtgcctgtaatcccagcttgggaggctgaggcaggagactcgcttgaacccaggaggcagaggttacagtgagctgagattgcaccactgcactccagcctggggctacagcaagactctaagactctatctcaaaaataaataaacaaataaataaatgaatctaagacctgaaactgtaaaaattgtagaagataacattggaaacacacttctagacattggcttaggcaaggatttcatgacaagaacccaaaagcaaatgcaataaaaacaaagataaataggtgggaaataatgaaactaaaaagcctttgcaaggctgaaggaatggtcagcagtgtaaacaggcaacccacagagtgagagaaaatcttcacaatctatacatctgacaaaagactaatatccaaaacctacaaggaactcaaagaaatcagtaagaaaaaaaacaatctcatcaaaagtgaactaaggacatgaatagacaattctccaaagaagatatacataatggccaataaacatatgaaaaaatgctcaacatcactaatgatcagggaaatgcaaatcaaaaccacaatgcgataccaccttactcctgcaaaaatagccctaagcaaaaaatcaaaaaacagcagatgttgacatggatgcggtgatcaaggaacacttctacagtgctggtgagaatgtaaactagtacagccactatggaaaacaatgcggaaattccttaaagaactaaaagtagaactaccgtttgatccagaaatcctactcctggatatctacccagaggaaaataagtcattacaggaaaaagatacttgcacatgcgtgtttatagcagcgcaattcgcaattacaaaaacctggaacctacccaaatgaccataaatcaacaagtggataaagacactgtggtgtgtgtgtgtgtgtatacacacacgatagaatattactcagccataaaaaggaatgaattcatggcatttgcagcaacctggatgagattggagactattattctaagtgaagtaactcaggaatggaaaatcaaacattgtatgttttcactcataaatgggagctaagctatgaggatgaaaatgcataagaattatacaatggactttagggactcaaggggaaaaggtgggaagggggtgagggataaaagactacaaatagggtgcagcgtatactgctcgggtgatgggtgcaccaaaatctcacaaatcaccactaaagaacttactcatgtaatcaaacaccatctgttccccaataacctatggaaatatattttataaaaaaattatagaaggaaaacagctataatgtagaattttatatccaaatgaaatgctgttgaacattgagagcattttaaaaaatattcccagactcatcctccctcaagtggtttgctacccaaagcagggtactaaaaacatttttagagaaattattcaaacaagaaattcaaatatagatgatatgtcaagaactatcagatgtacaaatcatctgatgtcataataaaatttactgttattcattaattttcttttaaataaacgttttattgttgtttcacacccctaaaaaatatacaaatcataaacatagatctcaatgggtatatcataataaacattcaatggatattataaaattaaaaaaagtaagctactattttgcaataaacataaataaccatgcaggttagggaattagctattactgacaacccagaattctcctaaactcattcctaggataatacttgcctaccttttccaggtaactaatgtcccgactttcaacaattttctcataatgctttctgggttttcattttcagattttgtattctagttagtaaattaattcctgtataattgatgtttctgatgttattgttagaggtatcttttttttcaaatttcaattttagaagttcttctttccttaaaaaagaaatgcaattgatttcaaatattatcttataggcacataccttgtaaatgtattcatataagagtttatctgtaaattgttcatttttttggtgaaaaattatcttaattacttctcctcaagttcttatatcttttttatttcttctttactttctcactagcaattttgtcaggtgtaaggttgaacaaagttgatcatagtcagtatcattttctcattcccaatgtcagtaggaaaatgttcaacactttgccattaaagaggtgctcatcacagtcattttggaggtagcctttaataatttaaatattttttcatcattgcaacttaggtaataggctttgtcactcatagactttggagttttttttttttagttatagagaatgtcatatgatttttggcttttattctgttaagaaaaacacactgcagttttaaaattttgaatattaaaacacgttcattcctgtaacaagcccaacctatgtttgtggtttacatattgcggagttttatgtataatatttaaattatttttagctaggttgtaagagagactggactgttactgtcttttcttctaatgtccttgtcacatttctatgttaaaattatcggtaaccttataaaacaagctgagaaatttttcaataggggaaatatgtaagtaatgttagttttctttcctgttaatatgttttggagaattctctagtgaaacatctggacctagaacttttgtacatatatgagaaaaagttatttattatggattttaaaaatagttacaggaatattccgatttttatgtcttctcatgtcagttttggtaagtgactttttcaagttttttacaaattttattgaaactgtcaaatatgtactgcaataatgtagctcataactttgaatttctttcttctgtaggatcagtagtaataccttttctttttatattactgtgctccctccctccctctctctctctctcacacttttttttggtctctgaattttgtaaaagattattttaacattattacaaggaaaaacttttggcttttttttgatccccttgattatgtgattctttttgaatgtattattttccattaatatctcttgtatgacttctattttcattggatttggtttactgtttggttttcagcttctttaaatgtaccatttttaagcatgttctattttcaacctgtgggtatttggactactggcatttaatcttttattctttgcaatatcaccattaaggctatagtttttttaaaaaaatcaatagctttagggctaaagggtttttggttacatggtttattgtattgtggtgaagtctgggcttttaatatagtcatcacctgaatagtgtaccctgtacccactaggcaagtttccatccctcactcctctgtcaccctccccgctctgagtctccaatgaccattttaccatctgtatgactttgtgtaaccaaggatatccattttcttgagtttcaatatgtcatacatttattctcattttctttctttttctttcttttttttttcttttgaagacggagtttcactccgtcccccaggctggagtgcagtggcgcgatctcggctcactgcaagctccgcccccctgggttcacgccattctcctgcctcagcttcccgagtagctgggactacaagcgcccgccaccacgcccagctaattttttgtatttttagtagagacggggtttcaccgtgttcgccaggatggtctcgatctgctgacctcgtgatcacccgcctcggcctcccaaagtgctgggattacaggcgtgagccaccgcgcccggcttattctcattttcttaaaatattttctaatttccattgagactaattttgtgacttgtgaattatttaggaatatgttgcttgattttaaaatatttgtggattaagttgtccttttgtaaatgatttctaacagtttaactgatgtcagaaaatgtattatttctattttcaattatgaaaatttgtcacggcttgatctatgacacaatatagagcatttgaataaatattaaatgtgcattcacattacatattcaattttaagtttatcgagtttaatattatgctatatatatcaattagatcaaatttgctaatagagatatctaattctttattattcttaattacatttttttctacttcttccaaccgtgtaagaaaagtgggcaaaagtccccagtatgatatggatgcattatatttctcccattattacattaatacaaattttaaattgtcacatcatggtatactgctcattttatcattttgaaaggtattcttttgtcttagtactgcttcttgccactaaatttatttcatctgatgttagtacatctatctcagctttcttttggttatgtcagcctaacagaccatttttacatttttttttcagacttcctcagttcttatttttaataaaacacattcaattacttttaaaattcattttagatatttttattagccgaagtatgaaaatcatttatatttagctcaagatattttgattgtggtctaccactttgctatttttccatctgttgtattttcgacttgctctttcttgccttttttctcaattaagcatttttttctccaatatgcccttataatctcctataagtttaagtatcttttgattttgccctagatattatttcatgattccttgacttattagtgtctgagtataaagtaaaattttcattacttttcttagactatgaagatcttataatacttttgatattttgttaggtagttttgttgatatttattttaaattttatatgatggattttatttatatagtcactatttatttagatttatccagatgttttgtcctttcttttcttgatttcatttctaaatttctacatttacatgtaaaataatttttcttctgcttgaaagacattattatttcatttggtgtaatgtataaatgatatagatagttcccttattttttgttttcctgaacatgaatttatttttttctcatattccataatattttattaggaataaaattctagttaccagctggcttccatttgagaagtcatccctaagtcatattgccactttttgaaggtaatatgctttttcctagaactatttttgagatagtctctttgtcgttaattctctaatatgagctatgtagttgtctccatatttatcatgcttcactctggcacttcctgagactgtgacttacagtttttccatctttttttttattttttatttatttatttttttttgagagagtctcactcttgttgcccaggctggagtgcagtggcacgatctcggctcactgcaacctctgcctcctgggttcaagcaattctcccacctcaacccccaagtagctgagattacaggtgcccaccactacgctcagctgatttttgtattttagtagagacggggtttcaccatgttggtcaggctggtctggaactcctgacctcaggcgatccgcccacctcagcctcccaaagtgctgggattacaggcatgagccaccatgcctggcttccaacatttttgaaaaatgttaagtttacctatttaaatgtggcttttgcccttaatatttctaatattctaatgaaattgcagccaatagttaattctggttaactctaactctgttttttggagggttatctaaggtgtgttacagttcatattcatataatcagtgattaagctggtttgagaccaaactgcaattattgtgaattataatctatttatttccattaatattcctaaacctttgaagtgtcaaatgaagcctggggtgtataaatcggcctttctcattgataagtcttgagccatatattttattctcttaaaactataagactatgaatatttctgcttaggtttttcgtctatcaatagccacatacatgtgagaaaatctttcatgggtcaagggatagtccatattgttctcaattctctgaagtgctgttttcttcggtattttagccctgtaatctttaatgccttggaatatttttgatacctccatgcatattttatacaattttcataagaagagagttgagtagagagtcagtttatagtttagagaaaagagaaaaacaaggaaaaaaataaagagaatgcaaattttaaaacaaaagcaattcagaattgaaattatagaaattatctatataatgagaaagatgaaattgaaatctaagaaacatatgactatgacaaagcaaatgtatctttagatacaatatacagatatcaatagtttaagaaagtaatatttattttcttatttaaaatgttaagttaattaccacagagataaatttaaatacttgttaaactaatatagtgagctattctatagacaaacaatagaagaaatggggaaaggaaacaaactaaaaatgtgagtaaatgtataatatgatgtaaattggccgaactaagttaaatgtaacaataatgacaataaatgcaaataagttaaaagcagtaattaaaggatcctgacttttataaattttttaataagagccaaaacatgttgttgacataagttaaaatttaaaagaaaatatatatgtatataactactaacattaaaattattttataacacaccaggcttaaatactaaaaagctagaggggcaatatttacatgacaacatgacataatataatttaaggtaaaaatatgtacattgaaatacatttattattaaagattaaaattatacgagctctatttttcaattaaaaattggagaaagagcagtggaggaaacccaatagaaatagttaatgaacaaaaatctttaaagcaacaacaaagaatgttaatctaaccaaaagttagtttttgagaaaacatttaggatacagaaacctgtggaaggttaaccaagacaataagagagactgtgtaatatgcacaattaaaaaattttaagtattaaaatagcttcattgtaataaatgtgaatgctagagatggaaagatgtaaggactgtaacaactaagacgtattaataataggaactaaagataaagaatataggattttacaggaagtatctaacaatcatttcaatatttatttcttagtctattaaagatcattccttcaaatcctcagataagtaaattctatcagaattttaagaatctgttatttattatgctacttctgaatatggaaaaacaaattgcctagctaaggctagcatatgttttattccaaaatcaagtaggtagcagtaattactcttaaaataatatttatgccagcaaaagagcacatcattttgtccgacaatttgtatgagacagcaaactgttttagtcaggggtttgagctagatatagattttatcgtgattatcattaccttcagtccacacaggcttcaaattcctataggaatggctgatgttggctgggtttaaggtgggtcctggggtgctggaggattttgtttagtacctctgttcccctctcagctttcagcatccttaccttcctgcaccgccgaggtgttctctgtctttcctctttcccttactcaatacgtagacagctgatgcttattatttggtatcaggcttggcataggggtaaaaagtggggtgttttatgttgccctgtctcagcctcattcaatcttaggtatgtcctgtgtgaaaaaagtccaagttttcattcctttttgtctttttgttatgttggttttagactactgtcattgaattaagctgaattttttttttttctcaaaatggggcattcttagtgttcttgcattgtgtccaactcatctatgacaatgaaactctgtcttggatctgtggttggttttgggtggaaatatttaccactctatagtagttaaaggcttcttcttgttattggtatagaatcttagccacaactgtttcctagcactcttccaaagatataggatgcattcttccacttgttcccaagcctcagtgcatctttgcctgtgattagtggaaatgacagttgtgctgtctcttctatagtggcttaaagctttgcttcctaagaaagaatgttctggggtagtgggcaaggctttttgccagtcccccagcagcaactgattattacccgaagcctgcactatgcagcagggtctctctcatcttctgcccagttcccagtctttcccttcaacagacaaagttccgtgtaaaagagtttaagaaatgaccatttcttgtgcctgaggcctcctgctattctaaacttacaatttacccacatttagcctttaagaatttattaaagtttagctgatttcttatatgattatatggtgacttcctcttcattttttgattggtcaaagatgaaactcattttgtgtcctttccatccttgagggcttgtccctctctggaatcagtttacttggttgccatgcaacttcatctctgatgggctgaaaacaacttatgactttgtagataattcaaatatttctcaccttaagggtgggagcatcattcttttcacctttctacatcctaatcagaagctgaaaatcacactgaggttttagaaattactcttccaagatgcaaaatattaagaatttccattttaaatcttagcagaaaaaaattactctagttggagtttcaccaaataatcttgtaaaatttgaagttttcttgagagacacctgccttcatctggtgtgaattatgaaaaccttagttacacttggaagagtaaatccttacaaatcaatatatttaacattggtaaacagacaagcaataaaaataaattataaagaaacaacaaaaataaatcatttagatatctaacatgatatatatgaggatttatcaaattttacctcatggtttaataatttcttcaaattaaagagaataccttaacactaatctgcctttaacaaataaaatttattgcttatagttcatacatgttgtcttattaatgcattagaaaaaaccttttagtataattttaaaaattatttaaaaaatatttaagtatgtttcaacagaattggtaccttttataatactgtgctttcctttatgcattttcaaaattgtgttgaattagaaatcaataaaattaaaaccaaaaaataaatagaaaaaaactgatgaaagaaaaaagctagttatttgaaaacatcaataatattgataaacttctatcaagattaactaaaacaaacagagatgacataaattattaataccagaaatgaaagagaggacatcattagtgatcccatgtacattaaaggatagtaaaggaatattatgaacaactttatgcacaaaaatttaatgacgagggtgaaatgtaccaattccttgaaggacacaatcaaccaaaactcacatgaggagaaatagataatctgaacaggcctttatctattaaagaaactgaattaataattaataccctgctaaatagaaagcaccagggctagataagttcactgctaaatcttaccaaacatttaatcaggaaattatatcgattctgcacaatcacttccaataataaaagtaaaaacaagttattctggaaagagggaccatggcacaagaaatgtttggcacagcacaaccagtccccagagaccaaagctaggccatatcttcaaagcccagagtgtgcatagcctgagtcaagctgaaggaaggaataaaaaaaaaatggggagaaagtcagggaatatatgatgaagcaaaatcttcatgtctgatgttctcagaatgaataaaattataaaatgcaaagtgcatatatcacagtttcagaagcaatattggtccaactgctgattttctaaaatggagaacagatcaacctctacacaaactgatagtgaggcagaatatcctggtcttcttattgtaagagaagaaaacgtctttcatggaagtaacagtgaaagaatccgttatcagaacataggacagaacgtttaggggtattttccctgcaggcactaattagatatatatcataagagctatgagcacacaggtttactatcagtgaggctgaagcagtgtaatttctgggaattataggcatgacacacatttgtgacaaataaaagacaatacagattaaactgctagatctaatgtcaacctgttttttgtagaaagcctagggataactgcccaaggtaaatttttacaatatgagcacctagtatttccagggacttctttactcctttccacattgcttttttgatgtatgacactttgattttgtctccgatacaatgaccacagcataaagaattagtgccagtaaagttagattataaaatcaaaaatttgactaagaccataggaaataaatcaatagaattacaagatgtagattttaaaattacttggtaagaacttgcttaactcaaaatacaagtacaaaatgatatatcagacaggagtcagacaggggagcaaagttagtaatgtgttttatgggataaaggacttattaaaggaattagatgtgtagagctgtacaagtagctgggaaactcaaggtctgaaagggaagttcaagaatcagaggacctctcactaacaagtcaatatgaaataccaaacatatctctttatgtaagggttgctcctgggatgccctttgagaggctgtgattttgtgtagctacaacctctgttgattcacatctaagaatcttttggtgagtcttgggctgctgttgatggacagaggcaacagtaggcaaaggtgttgaacgtggaatagagcagatttaggacaggttgcaagccggctggaacctctgcattgatccgatactgcatttgattatgatgaccttcagagaataagggccaccaccttacttcctttttcctagttacgtacaagttcctcttttggataatacagagaaggacatcttgaaaaaaaatgtacttttttgcctactcaagatgacacaatgcaaaacaccacaaataattaccagaattgaggaaaataagaattttctttctcatgaaaagtttagttgggaaaggtgttctagaatagccacattggatgggagggtagcaatgtttctccactcaggtgaggggagagtatttataaagctcgatgaatatctccaaaatttaggagtggcacaggagtctgatgtttaattaattattttccagaattagagtaaaagacaaaggctgataagctgttttgctggtaaattaaagaacagctgctaatacatttagattgtcaatttcatgggtttgtgaccactgtagttgtataagaacccacattcagtggatccttcaaaactttactgttactgtcttgaaatccttaataattttatctttgaatttgtgttttgtaagtgaactctgatgggacaatggagcatgagccaggagcatggggcctcagctcacatgtgatctcaccttttgccatcttgctcccccactgatacctagagaccactacaccacctcttacccagcaggggtctgaggccaaatacaaggagactcagggtcatatcctgagtaattttgagcgctctgtgagcatccctgtttccaaggcagagtgaaattaagagcaaagaaaaaacatcatgacaggtcaagaaagaaaccacaggaaaaaaaattctattatattttcttttgtttgtaaaagggatcctgcaaattaagtagctgacctggggtttcactttctggatttcagggcccacgaatgcattaccttttaacccagatcggaaatgatccacatgagcaatgaaagatggcagatggcttgaagccaagtgtgctttaagaacacttgggtgggattccattgcatggaatgaacttctagaacaggggtgttcaatcgtttagcttctctgggccacactgcaagaagacgaattgtcttgggccacatataaaatgcactaacactaacgatagctgacaagctaaagaaaaataaaatcaccaaaaaaaatcccataatgttttttaaaagtttaccaatttctattgggcctcattcaaagctgtcctggactgtgtgtggcctttgggctgtgggttggacaagcttattctagaaagtgaaaagtttcatgggaattgacagttgtagattaaatgatcacttactatcagttaagaaagaaatttctctcttcattaccactcctatttccagacttcagtcctagagtggtcagtagaagcagttatccaataggagagggggtaagtaaggtgaaaactgctgaaaaggaaaagaaaccaagaatgaccccttcccacagcctacagatgaaagaggtaggggagaaaacatatctgaattatattttaattaaaatatagaaattcatattataatttctgaaataaaattgtagtttacaacataatataactatctgttaaataccaataaccaaaagaagtcatgaaagctgctagatttttttacagatctggaaacttttcctgaatacatatttaaagaactacagaagacaaaaatgaaattgcattgaatgacaattagagacaagtttgttctttcgaaaaaattggatatttgctttgtaattttcaccaattttattttcctgaattatttctatttttaatgtagaaacaaaagtatctgagatgggtctaagatatcagagaattatctgtatttgtattgagatatatcaaaatataatgttaatatgatttgtcactgaactatatgataactcagtcgtacttctgtcttttaaaattggctacagttaaacttcaatctgtcaataaagtaaaagctaccaaagtgggaattctaaaattataacatgtgataaaatctcaggcagaagttttggattctgttgtttttattttctgccatttgtgccgatttgagcggtaactgacctcatgaaacatggaagtattatttatgtacaaggaactgacccctgagaaattgaaggtcagcactaaaataaaaatgtagggggaaatgcaactaataaaatgtaggaaaaaaatgtgaacagaaaatataataaacctacatggtggtgcttacgtagataaaactgaaagaggattgtaaatagaactgtaagaatggatttgtctaccatttattatattttgttaaaaataaagaaattcaatttacaatattgaattttactagactttctggtttgaaaagctagagtttctttttcctttcagaaggcttgtattcaggtaatactgatgaagagaatcctcaagacctttacactctgggtcagttccaagatggctgagagctgtttaaaacaaccaaaaaacaacttgataggattgacaatttcatgttttttaataagtgttgaatgagactgctaactacaatcagcagatatacatatgtggtgtcatagatgttaggttttcaaaaataaagaatgtgttagaaaaatgcctgcaaatcattcgaatgttacaaccttttaaaaaaaatctggctgttgagtgcagactgtgctgtttcaccttttattacaaagactcagtgaatgaaacatatttgatagcttggcaatagaagaaaaatttgtatttaaatgaggacagaagacactgggctggaattgatatgattatgccacaattgatgagtcataactaatgacaaagtctagagctcaggaagcaaatctgacaacgggagtgagaggaatgcaatcagcacactgggaggaaggcaggtgcatgcccacaggtcgtgccacagaggggtacttagcacaacacttgctcctcattgtgtatctcttggtttctaagcaaaggtctttggggagaaaagatgttattaaatactataaaactgaaacaaaaataaaattgagcctagctaggcacttgaaaatatactagtctgtgacacagtaaaagaaaaatcatgtggataggcaacagatagttttggaaatttaaaactcaggttttgttttatgtcttcatatatgatgctgaggtaacagatataaaattaggaatttgtcagcaatagctcctcctgcctttatcatatgttttaaatgatttaacagtgacattttattgtattttcttttttattgagattcatttcctatcttgtctaatattctcctattctcctgatagtttacacacaattatcacaaaacactagcagttccactaattttgtcttcactatcctcagagactttctgaggaaataataatattgtttcttttatctttatctctggagcttagtagggtaccttgcccattgtagttgagaaatgataaataggaatgactgaaaaaaaatacatttgaaaacagcttgaacataagaagaagcttgagatatttataatatggacacttgtttttttcctaaagcaaagctattactattagttagagattatgtagattttaatttctttatagaagacaaaataaaactagtagattaaaaaagttagttcctgccactattcttcccccaacaagatatctggggactgagtgccagaatgagcaaagaaagattcaaggaccaagactggtggaatcctctcactccagtattcttagagtcttgcttaggcttgaagcataacactgttgtcacatcacttgacaatgcatttacggaataagattcagtgagaaagaacaaacaagaagtgattatatcctttaaagagctttctcagaggcatcggctagtatcttgtttgcttctcatttgccagagttgcatcaagtagcttctcccaactgctcaggaaattgggaagtatagttttctcaacattttcataccaccacaaacactcccaagaatgttcataagcagtctgtaatacacaggacacgtcccaatgaccaagaattatctggtctgaaatatcaatagtggtgaggttgacaaaacttcctctgaagcacccggcattgggataaggtctcaaaggaaacgttaaaagacaatgcaaaatgaagaagaatatggggtaccaaaattatagttatcaatcaaccacagaacttagttttccccaaatatctgaaaggttgtttgacttgtcaaaatggaaacaatgtattcagtactgcttcagaaggcaaacctaaaccaaagtttgaaatctgtgatgatgaacatattaaaattatagaatcatttgaaggttattattatccagcagtaacacagtagatgcctttacagaactgaatgtaatgagagactagtattgtgtccctttgtgaagtctttaaattataacagtttcaaaatatatgaagattttgaccaaatcagaacaaaggccattcatgatataaaccactttgagacagtaagagctattggttgggtctatagggccactagtctaggcctccgataatttatgcaccaggagaaatgtctttgaggaacagataattgcctgcatgcctctcctagacatgttggtggaagctgcaacaggagtggttattattaatcccttttagaggacaatactagtctcacctctgaaccacccatcaatattgtgctcaattagcactttgtttcaattgacaatgaaattatatactgaaaacagcatgaatccatgacctgaccagaagcattctctagccagtgaatgatttttctatccttgcctccttttcaatttaacaaaagaggataacactgaattcagactacaggtgtgcagatcctcattgttttaagtcatcagaaagaacagaattaaaaattaatttaaaaactaggaatatttatatcgtctttcctcatagttttcctcttctggtcttttgccttaatagttatttactatttctcattcatatttggtagaaagtgtcattatacaatgtataacaaaggtcttgagaatacaaatgtataactctttcatataattataatccaaagaaatctttaatatattcatgttaaacatcagtttatatgatatttgcaatccatgtgaaaaaaccattttacaaaaacattaaaataaagcccaagtttttgtatttgagtgattcagcttaagaagacttatataatttacgaaataaatacatatcatttgagcataatgcaacacacctttaaaaaccacttgtttgaaaagaagcaaggcatatccactgattatatacaactactgctttcaaaattttcacttttaaccagtagacttttcatcagtgttttatattgtcagggtgttttttgtttttgtttttatgatttaatgtatttaacttgtttctctattagaacagaaaaaacacatacttctttatttcttctgcattcctttccatttgttggccatgacagcagttagattatacccctttctactgaagcgttgtgctaagttttgggagggcaggagaaaatatcttcagcttgaaaaaaaaaatacttgaataaacaggtaatttttttattaagatatacaatggtcactttctttagtgagttatgacaatctacctctgaagtacaacatgttagagtcatttgctctggacaaagtcactttcaggaatggttttattacaatgaaaaggaataggtatactggctcttaagtgccactattgccctttatgagaatgagaactagattagctggcacgcttatatcccacactctttatgagccttatatgttttggggtattttcatcattttaatctggatgatgttattttcagaaacatcctaaaacaattttcaaagaagcaaggaaaaggttaacactgaacttgcataatattcagtcatgaaaatgcatttgaatacatttgtttagcaatgctaacatagcaatcttcagaagttgcccagagatatcttttgaggtttcatattatgttaaacatgcaaaagcataaaaacagggaaaaaggaaatggtataacaataaaaaggtttaaaatgatgaggaatattcatttgcttccctgattaaaattaagttttataattatatggataccaatatattagaattgttatatacaatctaatttaaggcataagagataagtgtgttcaaggggagtagcgaaaaaagtgctcttaatttttctttttgattttttgctgtggttagtgttaatacatgtatattgaatggatatcttatttttaaacaacaaaaccttatttcaacaacaccaatctacatatacctgatattttatataatgcactaatgaaagcattgtgatgttaaaattagcattgtagaaaggaaattgataaatgtaactagcaaatattaattttgggggatgaatattttctaatctatttctgaaaaactattacttggttatactaatttatttgagggtaccttcccctgtatcatttttacctccacttttgaaagaagcaaacaatactccttctgaaaaataaattttaattctacagctttctatgacaacttttttgttattcataccaaagatgaagctatgcccataccttattgattatatatgcaaagagttctctatcaggaaagtttcaacatgaaagatttcttcccactgaggagtctctccattacagaaggtcaactggtaaatgttattctgtttccactaataaccatttgatcctcttttagattttcattcactctagtgttaaatgaatctttgctgaaaattattaaatcaaaactataataccttaatagagaaaaatgaatgttatgaggcagtatctcaccatcaaagttgcagagacatgtcttttcaaagtgaaatatatagcttatctagttaacaaaagggcagcaaattcctttgcaggtctaaaattgagccagcaaagtggtggtttacaaacagatgccagtttcaattttcatgttagatgatcaaatatatattgagtctgcataggaaatgctgttatcacaggattcaacacacaatgtcgaattcctacatagagaaatttcattttttcattacattctgtacatgcaaacttcctagctagtgtggagaaaacctaggaaaaaaaaaagtttaaggtgaaccttgaaggatgagaatgaatgaagtacagacgattatgtaaggtttgaaggcatgacactgtatacaattactgagtaaggatggaacacatccacactagtgatgagaacaaatttatattttcagtgcagtacatccattcattcttgattccttcttagacattatttcctaaaattgagccacaggatggtcagaatggtcagatctgctaccacagggaactgggacttttgtttaataatacatactccacaaacatgcacaacctcttctcctcttttcccccagagtagctgattctactacagtgattcatatgacctggatgggtaaaggggtatatgcaatcaactgagttcattagaataagttttaaagtgttaaagaaatgatgaggctgggcgtggtggctcacgcctgtaataccagcagttcgggaggccgaggcgggaggatcaggaggtcaggagatcgagaccatcctggccaacatggtaaaaccctgtctctactaaaaatacaaaaaaaattagccaggcgtggtggcaggtgcctgtaatcccagctactccggaggctgagacaggagaatcgcttgaatctgggagtgtcggaggttgcagtgagtcaagatcgccacggcactgcagcctggcaacagaacgagaccccgtctcaaaaaaaaagaaaaaaaagaaatgatgactccctgtaacaattgcctggtgactatattcaacttagatcaaaacaatgcaaaaaatctactgtaaactgtgccatttctgtatcaggattttaccaagttagcacaggagtaatttatattttgagtttaaactttagagcagagcttttaaatggaaaattctgtgacaataaaaatttctataatatactgaaaccttggaacaagaattaaaggcatacaatggtatatttatggaacttttattttattttgattaatttaaatacaaatgtaaataacctcatgcgtctattggctaccatattggatagcacaactgtacagcatcagtaagatttaaactcatacgagtattatcaaatctactaaaaatagataagactttttcctatcttaaaatagaactaaggtgacattttttttccacagccatattaatggatagcaaccttttcaatactgtttcctcataagtgtatggataaacggattccaaatatatttggttaaaagcaaggcaaacaaatatattgaattcagataaggactctaggtcagagatcaatcgaaagtgggtcctgatttcaagactacattattttgtgctgagtgaaacaaatgaaagctaactaaagtaagtataaatgaaataagatttgtaatataggtaaagcaaagtgccctaggagagcaggaatatttctttccattgtcagatataagcatgatatttgtggtgggccttgaaagactagaagaataagagatgtaaacaacaagacttaaaggcataaaatggtatattatatttatggacacttggagttctcactattaagtgggaggtattgataagaacacatggacatgtagatgggaacaacacacaaaccagggccttctggagtgcagaagttgggaggagggagaggatcaggaaaaataattaatgagtattaggcttaacaactgggtgatgaaataatctgtacaacacatccccatgacacaagtgtacctatgtaacaaatctgcacctttatcccttaacttaaaagttatatatatattaaaaaaaaacagtgaagtttgaagtgatgctaaaagagcaatctggcaataggacatgaaaggtcatgatgctatgtctggaaatctgaaacttactctgtggatgatagagccaaaaatattttaagtataacaacatgatttgatctctgcattaggaagatagccgtatggcaatatctggggatgactgcaaaggtaagaaattacaggcaaggaaaccagtgaagaagttactagctataattcaagaatgataaatacttgaatcaggctagtattttagaaggtatgcaaagtaaaggctatctttctgggccattgcaaagttgggaggtgattactgaataaaccaagcatcttcgggagaggagacaaaaacagtctgtgccatttcatttcgaggcctggaataaagagtgatgacactaagagaaggtttggttctaaaatacttctttattttcctgatttttaggttttttgtttcaattggaaaattcctagtatttttgtgatgtcagtgaagaaactgatgattaaagagaaagaacatgagttaaacagaatgtacaattcagaaactaggttttcaattatagttatatttttaggaaaaaaaggtaaagcaaatctaattttaaaattcagtcaatacgaaagtgtgtaacgcaaaataaaaagcaaaattaacctcacacctacctattaaaagagtttccactgttagtaatttgcagtatttactttcataactttttctacatatgtataaacatatatacatttttaaaatatgaattatttctcttcactgtatatttgtatgcagaaatatctataatgcatacctaatagcactgctgaattatatacttgcttgagttgcatactgttgcagccctacaggtacatatttttatttacacaacttggatgattttcattcagtgaaacaatttattaatttattccttccatgtcaatgaacgtagagctttattattattttccatggttttcagggtattccataacacagacacatcaccatttattctttctgtagtagacatttaggggatttaaaatgtttacattataaatactgacaatttagtaattagtgtcttagataatttattccaagttaaaaacaaaaatagagatttaatgtaagtccaactgagaaatctataaagtaggcaaaattttaaagttatcatacacataaaaattcaaatgtattcttatctactcatagttttagtaactcctctgataaaaaagagatcatagtagaaataatcagatatgaaaaaaattaaagatttaaaaatttggtatgtattactctccactgaagacatgatcttattggtaattattggaacatcatgctatctacatacctattattttagatatttatctatccacatagattccacgtcatgctgacacacacacatccaggtgtacacacacaatttgggcccttttacactatatcattttaaagtgatacgtgctgagatttcatctatgaaatagtcacccaattacagttcagagaatctccatctgaaaagaggtgaacacaattttcaccttgtgaatattcagaaattgaatccagggaagaaatttactgctagtgaacattgtttgtatatgaaaaatgagaacctaggaagtggctattttcataatgatataaatctggaaacacaactagaaatacacttcagctaagtaagaattgcaaagaactttgtactcgttcaaatgaaattatttcctggcagggaatttcttttttcagtttctctttaatttcattcagctcaattctattttgtaattaccaccttcataaaaagtaatcataataaccagttcttctgaagatagagaaacaagaatatggccaactaattacaaacgtttgggaacacttatcaataaaatgtataaaaccaattcattttctgccaataacatgatcatgtatgtctcaaatcacaaaagacgatgaattatgcaattatttttctcttgagatccttaaagattggagtaagaataaggaagttatattatttttccatagggactaaaacgtaatccacatgctttaatataatgggctgcttgtttgcctttctgtgagacaaggcaagcatatccaccatacacatggcattgatcagtcaataaatcttgctatgccaaaaccacaaatttaattggttcagcattagggatcccatatattagtttttctcacgaccaatcccgtttgggaagattctaatacatcttcaaatgcaacttctctattgtaaaactgataggtctagaaaatgtggagaaatacagtgggaggagaggaaaaggggagaaaagagagatgagagaggggagagggaagaatggggagagagacaatatatgtttttaaacatttggaaaccatttgcttccttttttcttttacataaggcaaataagacaatatgcatagaagtactttatgtttcaattttgagaggaataatttaagaaatgtgatcctaggcttattgtaagggatagactcattctcttatcttctaggagcaatttttcttaatggtttttgaaactgctgaccaaccattgtcattaaaaccctctctcggtttctaaaatactgaattttccttataccttataatcttcttgactactttgacttaacttttgacttagtttctatttacgatctaccataaaatagaaatgtttatttaataattatttatattctctctgtgtgtacacataaacacacacacacacttccacaatcctgttagaaagttattatttctaatttataataagaatacaatgaaattgtccatttaataggaaagcccaagataagatagtaaatcctgaagccacaatacaaacacaattcagtctgatttctaagactatgttctctcgtcacgccatgctacatgtgcccttaataccatggttcaacgttcttcagttctcttactgtcatcatttataattgccttttgagagatctcatccattcttaagatttgaatgtccacttctgcatggatggcatgcaacatctccagtactggcattttccatatattgctgtaccactttggaaatgcactgactctttaaaagccacataaatgttcagccattaaattcaaagttattatgtcttaataaaaatgatttcctcccatctcaaatcattattttctttcaactatcatatacaataacctgttacacaaatccgtacgttgtttatggtattttgaaaccatatttttatcttcattcttgtttgtaaaagataatctattattgaattctttcacacatcactctaaactcctttgcatttttctcttatccacttttactttcaagatttttatctaaccgctttatcccctacattgtgattcatacgcagcccctgggaagtgaggagtgcctctgcccaaccacgatgcaaccctccaggtgtgaggtggcagccttatgtgtgatctttctgccctccccaagtttgcattttcgacactaaagtttacttttacattaaaaataataataataatatagaaaaaggttttcctattagagtttctgtttctaaattctgccttaaatccaggttttataaaactatcgttcgggcattgtgcctcacacctgtaatcccaacactttgggaagccgaggcaggtggattacctgaggttaggagttcgagaccagcctagctaacatggtgaaaccccgtctctagtaaaaatacaaaaataaggcagacatggtggtgtgcacctgtagtcccagctactcgggaggctgaggcaggagaattgcttgaacccaggaggcagaggttgcagtgagccgagactgcaccattgcactccagcctgggtaacagacagagactcattctcaaaaaataaaataaaataaaacaaaactatcaatatttctagtgaaattcatatcactctaataccttaagatatattatcaaaatctcctacttaatcaagccctgtaatctcccatcagtgaaactcatacatacgtgggacggggaaaaaaacaaaaaaacaccttttcttattgctggaaacctagagtagttttgaattagaaattcagagttgctttgagttactgttattccatgagaaaaacagtattttatggatatttctaaacttaaaaagatagatctaaccaaagatggcttctcccagtgatttttgatctttctaggggcagtatataatccattgcaggaagctgtggtgctatcagaagctgaaacatcaagaacccagattattcacattcccctgcctcctatctcctctctctctccttccctcactgccccactcattgatcatttactatttcttttcacagtgaattatgcttttatcatgaatagtatctaggtttataagtgtacagtaatataaattctaaattcttcggtttaaatgtattaattttctctcatactttacatcctagaatgattatcttggattatggtgttcctagacattcttggagtattctttatcccaaactatttcaaatttaaagcttcaatctctaaaagactgttagtaaaattaatttaatattttacctgctcacctctttgctacactgggtctttcctatctgtggattctatatccatggactcaaagggacacagattgaaaatatttgagaaaaaaacaataaaaatagcaatacaacaataaaaataatacaaaaatacagcataacaactatttacagagcatttacattgtattaggcatgataagtaatctagagtttatttaaattatataggaggatgtgtgtgagttttatgtaaatactataccatttttaatcagggactagagcatctgcagatttcgatatctgaggggtcttgaaaccaatacttcacaaatactaaaagaagattgtacttctgtatctatctgttttttgtacaattgaaagattcagattcttccctttttatctcagtttataagcaccccccatagtttttctttcatctaaacaaatgatggaccatttaaaacagaaatttcatgcccacattcttagtgtttaaatctcttcatttatgttctaccttccatgatgatcacaagtactggatcactgtaccaattttttttctctttctgtatcttgatatcagaatgacattagaggaaaccacgtatttgtgtagattatgacactctaaacctcatctggtctatatgaactagttaaacatgatctttatcagtcaccttttccatttcccacataagttattccaaatggatacaaagcacctcaagtccctcatatttccaccgctacaaatgcaaagggtgaatataatcatatgggaaattgtggttattagtaagattccttcaatgtcctgtctgtatctctttatataacaaataaaaagaaaagcagccgaattagaattttactcattttcacatctttttctataggcccacaggatgagcttttcaccgttccctttttagaggggatttttccaccagtgactttgatttctatactttcatttctaccataacctgaattctgatctcaagtattttcaactaatgttcagacacggtggctctgtcatagttcttacagtcaagtctcttatttttctctcacaatttccacctccgagtagaaactaccctaaatcctcgcctttcattttcagtcaagtttctgaaaagaatattctatgaaatgtttttcaaatctggctgcacattagagtcaccttggggaggttttgagccacactgatgtccttttccctcctcaagaaattctgattccgttggtctagggtacagtgacaggcataattttgttgttgttgtggttttctcttttgttttttgtttgtttgtttttaaacttcccatgggatgggattcttttttttttttttttttttttttttgagacggagtctcgctctgtcgcccaggctggagtgcagtggcgcgatctcggctcactgcaagctccacctcccgggttcacgccgttctcctgcctcagccttctgagtaggtgggactacaggcgcccgccactatgcccggctaattttttgtattttttagtagagacgggtttcaccgtgttagccaggacggtcgcaatctcctgacctcttgatccgcccgcctcggcctcccaaagtgctgggattacaggcgtgagccaccgtgcccggcccttcccatgtgattcttatacgcagccgtattttgaaaccactgttctactaactcagacaatggtttctcattcctctctcatgtactccaaatactttctacttctacttctcccctaaaacagttcttttgaagggcactaatatctcccttgatttccaagtccagttaattatttttagtttttgtattattttttcatactgagtctcaacttttctttaaaagccttgctttctatgacatcattctttcgaaatccatttctatatttttctcagttttcagttctggttctttttatccttccttcctctcaaaggccactgtttcccaaccttctgctctttgctcctttttcgtccttctttgtaagcaccctcatgactccctcctcttgcagggttccattattacacattatgtttctgtagcccgtacagacttttgctgtataacatcagattcacatttaagaacctactaatggctgggcgcggtggctcacgcctgtaatcccagcactttgggaggctgaggcgggtggatcacgaggtcaggaggtcaagaccatcctggctaacacggtgaaaccccgtctctactaaaaatacaaaaaaaaaaaaaaaaaaaaaattagccgggcgtggtagcgggcgccagtagtcccagctacttgggaggctgaggcaggagaatggcgtgaacccgggaggcggagcttgcagtgagccaagatagcgccactgcagtccagcctgggcgaaagagcgagactccgtctcaaaaaaaaaaaaaaaaaaagaacctactaagtccttccagaatggtgttccagatccacctcaaataccacgtttctgtcaaacagcagcttctccacctgaactattctttctttagtatcatgattccccagccctgacactcatgagaatcacttgaggaaatttaaaattctgagactgggctgggtgcagtggttcaggcctgtaatcccagcagtacctttgggaggccgagacgacaggatcacctgaggtcaagagtttgagaccagcctggccagcgtggtgaaaccccatctctactaaaaatacaaaattaagcctggcatggtggtgcacgcctgtaatcccagccactaggaaggctgaggcaggagaatcacttgaatccaggaggcagaggttgcagtgggccaagattgtgccacagcactccagcctgggcaacagaggaagaaagagactctgtctcataaaataaaaataaaattctgagtctgactttcagaaatgttgatgtaattgatctggggtacctagacattgagattttaaaaatatttcaggtgcccctaaaaggttcaggcaatctgaaagttaggaagcacaagaatgaattttagtatcagggtattcaaaggtggtttcatattagaatcaccaggagagcaatttttaaatactattgtagacccaaacccatttcaactgaataagaatctctgaggttggatttcaggaattcgtatttttttaaagttccgcaggtgatgcttatgtgtaggcaaggttgaaaaccattgctttagtagtttcatctcaatgaatggcactgttttccacacaattgctcatccaggactgggagtcatgttaaacccagactttatcctcacctttctcttattccacactcaaataaaatccacatcccatgaatcctacatttataaaatattccttttaaacatcttcttttgaatgtctaatggccatttcaagttttaacatacataaaattaagtttttgacatttctacccaaaacaggacttgcaaagtccaaaatatcattttgacattttttcctaaaatagtactacaaataaaaaatcagtattgccaattttttgaagcaaacttatttgaataatatagactttttaaaaagatctttggattttgtttttctttgttcctttaggaaagagtattaaataataatatttaagattatagtactttgagtatatttagatagaatgatagaacaagaaatttaaagaacttctgttgttggaagaaaaaaacttataaaaagatttcatctctttgtcatgagttaaaaacaaacattttaaatgtcaataaatttccaaaggaaatttggcttatagtaaaaaaaaggaagaagtagtagtatattgagagttagtctcagctccttgaacttgagatgtttctgtctatgcccgtttcttgtctttttaaaaataatttaaatttagagcaataatctgttatattatcctctgtttttaatattgattcatataatttcttagtgtgctgcttcttttgttctttcaagaaaaatgaaactacccagagatggatttgcaatctaggttttcactaccttttgtgcccctgagagccagtaaatccagtctgttttgataatattttagccatgacacaggccagtcatggcaaggaaaaaaaaatgaattcataagaaaaaaatctgtatatttgtgaaaaaatcaggatctatcatatcccaagtttatttggtggcattaacatataatagtccatttgcttactccccataaatatgtaaaaaggcaaagagaaagtaaaaaataaaattattcttccactcacacaagtggctgaataggcctaatcaatattaacttcattgttcccccataattctatatgtttagcttttaaacatctatcttttaaatatgctatttttattaatttgaagttaatcaactaaaataggttcattcctttcactttaccagtattacaagtgactgtctaggagcctgagttctaatgaggcagccattccaaacatgtacagacaaagcagtggtttccctggcaacgagaaccatgaaaaagctcttagaatagttattcccacccttacacacaactccttttcatttcagtaaagcttcctgtcagaacacattcatcaatgtaatttgccaacaaagtttaagagattaaatccccctccccacaagaatgtaaaaataaaaaaacaaaataaaacctacaatcaaaaatcaacagctatgctgaaattgtagttaggtcatgaggtaatgcttcaaaggaagtaaaggacatcctaagactcctgaatacagttaacaccactttgaacctgagattaattttcatttgatttttatcagaggatacagaaggtagatgcatcaggaggaggggcaggtgcctttaatcattacctctagcattatcacttacaacctcaaagcagcttttatttaatttagtaaaagtttataaaaatttaaattattgtatgcatcaaattaagatttaagatgtccttcataaacattaaccttttgttggtgatgtttaccaagaaaggtaaactctgaaaacatgatgtcatcgtttcaattggtggaattaagtaaaagattttcaaatgaagcacttgaacctattttctatctatgcatgcagtagaaaaaagcacacaaaacaggcagcattttgtgtcatgtggcatttcaaacaagagggaaaacacatctggaaataaaaggtgtttagttgaaagaattgaccttaaataaaacaattgcaacacttgatttgggcttcttactggaaatcaaattctttgagtttaaaatacacctactaaatgtaatacaaaaccaaaataacacactttcagcatttctcaaaatgttagcacccagcaaatgcagagtttacagttctagtgattttccctgttcttttcatggaatgcatatctaacccgtttttcagccagcatgctacagcaaaggaagattcatgttgtccagggctatttctttaaaacagtatggaaattacttttaccataaattaggttgtgctttaatgctgagaaaggtctattttgccttcattttgacccatgacatacttagccttacaacagcataatgagcataatgaggtcaaaactaacactgcaaaataaaacacacccccccacacaaacacacattatttctcaaggaagatgaaaaaaaaaaaaggtcacattgattttcttttttttaaagcgggacattctcactacttttttcacctgaagattgaaaaggaaactcatttcagtttgtaacattgcactgactgttccagacacaaaatgaatcaagtctcctgttggattatgtggttagcatttcttctcttctctggtgagataattcgttacttaggacagctgtggtataaaaactcaaacattgtcttttgcagaatggatttgaaaagtgggcccccattctatttttgttagaaaataataaaatcacaaattttgtcatgtatcaaaaatgaaaagtgaaatataaatgtgaaaggtctgatatttacttaatgaatatttaccaaatacttagcatttgcatattaagtacaagcctcagggaaaaaaatgtagccgtgtttaaatctcaactttatttcttccccttgctttattttttgaaaaataagaaatattcacattaaagaaaaaagagaacatatttaaaaatattttcatctatattctagtctaaccagagtatctataatttatattagttaccaaatgtattagacaaattaaaacacaagagtttttattattataatgcttttttaaaatatggacattcacaattttatgcttacaagagaatatataattcaagtactcccatgaaataaagtaccagttctctacaatcaaacctacagtgctaaacgtcagctgaaaattacttataaaactttcaattaaacttttactagtttaggtattctcttcatagttgagaaatataatgcaaataaaagttgagtatgcctccctgcctccaactaggacataaagttgatcttccatgtcatgtttcttaaaagtaactctaaaataagtttctttcaaaccttctaaattattctctttccctaatggcttgttgtattcttccccagcagaaattactaaaatagccctattgcacttaatctaattagggatttttggagaaatggtggttacatagttctcattaactgactaaaaaactgtaccatctccagaggtatagatattaaaaagcgggggagggggatgattccttttaaagctccagaaatgaatgtaagtgttcatattctggtacattaacagtttgttccagtacattgatattttatgtggaagccctactctgcaattaatatgcctgatgcaaattgaaaaacccataatccatccttctctgttggaatgtaagagtatattattattgagaagctacaggataccagaaccattttttaaacttgactgctcactaccttaaatctgcatataaaacagttttgcattcagacgaggtaatacataccggaatatattgtggcgcatattaaaaaaagtgctccaaataaaaacgacctgtgggcttcctttgtagaagaaatttatgcagttccaggcattagggattaatgacagctaagagcaaaagagaaggaatgagcattaaaacattgtgcctaactttcctgactaccccaaggctaaaagacaaagtgaattgtcaaatctccttaaaggtaaggactatgaatttatattaagtaaatatgatatttggggattgcatctggttctgtcacattagtattcagtatatttcttatagctttaaaggagaaaagacaaccttaatggaggtatgagagaagaaagattttaaaaatcctttgtttctaacagcttagagagcctctttcctttgtcttgtttccaaaattatgcatacaattcttcacaggacataaaatgctattgtctgctatgactgacaaaatccaagattttaatgaaagttatactgtaactattttaaagggaaggggaatcacacatccctaagagattcaaatgtaatatattctcaaaaatggaaagatcccagggatacagatttctttctttcacggatttctcctaagcctgttcaattcatttgatcatcaccgcctgtgatctgggttttattaacatttcagcatttgattggacccttcttacctctctgtctatccatcacttaagacatttagtgctgcctactggcagttatctgtgtaattgttttatttcactcactaagtgataagatccttgaggcaagacgctatgcgatatggcctgtatcttccacaataagtaatcacattgattcaaaagattccctcacaatacatttttattgcaaaaatgattttgtatttatccattttggaaaagaaattttatctcttgagcccctaaaaatggaattgtacacattaagacccttacacatatcacataataatcttcagggtcaaacattatagttttcacctgctgctattcctttgcagtagactagaatagagaattatataaaacttctatgactgtcaaaaaaatgatatattttttgaaatcatgtaaaatcaaccttctttattttacagatatagaaatttagatctgtaaggaccatcagtgtggtgaaggtcacatggtaagttaattacagaatcaaatttttccctttcatttcaatctgtttttaagttttacatgattccactttcaggaaaaagcaattaaaatacagactggctttggtaagagtgatatatatttttatgtttcagaccagcatgttgtttcatgctgatgttaaaagataatggttgatatcagataaatacccacacatacacacaaacacaaactaacttggggtccaataaaataagactgggtggttcacatatttttccattagtgcaaatattttacagagataattttctttgataaaatctgtgttcttaaaactgattaacacatagtccttactagaaactctttacaaaaaaaaaaaaacaaaaaaacaaaaaaacaaaaatgagagtgcaaaaattgagagaataagtcaaaggaaaaagagaagttctcccataacttaaattcattgtacctgtacattaatcaaagaacaaaattgactgtcatgtgatttgactcatgctaaaatgtccctcacaatgaaaataatctcttttattggcccctcacagtgtttaaaatttttcaccatttaaaaaaaaattgacttaaaatacttcatcttctgacatttttgttcacaaaaatagtaaaagtaaaggaaaaaggtagataatataccaactttgcagggtattgcaggaagttcagagagggaaagaaagaggaactataaatagttatcataaattacagctaaatattttagtttagcataaagagggtatgatgaatgtaaacaacatcacatatagttcaaagtagagttgtggaattagttttccatgacaatgtttaagaattgtacagctttgctgttatctagtgatgtgtccccacccaaatctcaccatgaattcccatgtgttgtcagagggacctggtgggaggtaattaaatcatgggagcaggtctttcccatgctgttctcatgatagtaagtttcatgtgatctgataattttataaagggaagtttccctgcacaagctctcttctcttgtctgctgccatgtgagacatgcctctcaccttctgcaatgattgtgaggcctccccagccacatggaactgtaagatcattaaacctctttcttttgtaaattgcccagtcttgggtatgtctttatcagcagtataaaaacagactaatacagtaaattggtaccaggagtggggtgggactctgttctaaagataactgaaaatgtggaagcaactttggaactggataacaggcagaggttggaacagtctggagggctcagaaaacaacagaaaaatgtgggaaagtctggaactccctagagacttgttctatggcttgaccaaaatgctgatagtgatatggacaatgcaatccagtctgaggtggtctcagatggacatgaggaacttgttggaaactggaacaaaggtgactcttgttatgttttagcaaagagacttgtggcattttgcccctgccctagagatttgtggaactttgaacttgagagagatgatttacggtatctggcaaaagaaatgtctaagcagcaaagcattcaagaggtgactttttagccggacatggtagtgtgcgcctgtagtctcagctactcgggaggccgagacaggagaattgcttgaacccaggagggggaggttgcagtgagctgagatcataccccactgcactccagcctgggtgacagagtgagactccccaaaaaaaaaagatgtgacttgtgtggtgttaaaagcattcagttttaaaaggaaaacagatcataaaagtctagaaaatttgcagcctgacaatgtgatagaaaagaaaatcccattttctgaggagaaattcaagctggctgcagaaatttgcataagtagcaaggagctgaaagttagtcaccaagacaatggggaaaatgtctacagggcatgtcagagacctttgtggcagtccttctcctcacaggctgggaggttttagaggaaaaaatggtttcatgaggcaggctcaggttccctctatgtgcagtctagggacctggtgccctgcatcccagctgctctagccatgactaaaaggggccaaggtacagctcaggccgtggcttccaagggtgctagccccaagccttggcaggttttacatgttgagcctgagggtacacagaagtcacgaattgatttggcaacctctgcctagatttcagagaacgtatggaagcacctggatgttcaagcagaagtttgctgcaggggcagggtgctcatggagaacccctgctaggatattgtgaaatggaaatgtggggtgggcacccccacacagagtccccactggggcactgcctagtggagatgtgaaaagaatgccatcatccttcagaccccagaatggtagctgtaccgacagcttgcactgtgcacctgaaaaagctgcagacactcaatgccagcccatgaaagtggctgggagggaggctgtgtcctgcaaagacagaggtgcagagctgttcaagaccatgggaacctcctcttggatcagtgtgacccaaatatgagacatggggtcaaaagagatcattttggacctttaatatttgactgccctgctggatttcagaatttcatggggcctttgttttagccattgttttttccatttgcaacagctgtacttacccaatgcctgtacccccattgtatgtaggaagtaactaattttcttcttattttactgactcataggtggaagggacttgccttgtctctgataaaactttggactgtgaacttttgagttaatgctgaaatgagttaacactttggaggactgtttaaaaggcatgattggttttgaagtgtgtggacataagatgtgggaggggccagggtgaaatgataaggtttggctgtgtccccacccaaatctcatcttgaattgccatgtgttgtttgagggacccagtgagaggtactgaatcatgggggcaggtctttcccatgctgctctggtgacagtgaataagtctcatgagacctgatggttttataaagggaactttccctgaacaagctctcttctcttatttgctgccatgtgagatttgcctttaaacttccaacacaattgtgaggcatccccagccacctggaactgtaagtccattaaaccttcttcttttgtaaattgcctagtcttgggtatatttttatcagcagcgtgaaaacagactaatacagctagggtggttaagatagagatatgggcaagatagaaatccttaacaataaatacatacattacattgtttcttccatctaggatggttcttttaacctacaggtaatcactttgtgtgtttcattaaggtattttcaaaatctctttgaacagcataacttttaaaagcaagtactaatactttataaaagtatttcataaagtagtttacagtaactgaggttgatttgtgccgttaaggaaaaaacttttacttttttattactaaaaatgtatgtaaatctcactggcactgaatgcatttttcaaacaaataaagaggcttgaaatggtgaacagctattcttttctgcctactagggatgagaaagtacaggctgttttcaaattaaaaccggaagcatatacaatgagacattatgtggactgttgtgactattagggttgttagatcatgtgctgtgttactgtgggatgtttgggaggatcctttgaatatattttattatcaaaaattttatttttctgatgtatataatcagaaactcttgaagtagacaactatataaatattaaatgctcacttccaatataatattcatttgattaataaaactggagacaatttatcttagttggtggattatactatactcatccttggtagattataccataaaactgaagtatttccacctcaggaaatattcccaccagttaagttgatgtgcattgccagagtatagttactttgttgaatttccacatgtaaactcttttattgaattagatatgtagaaaagtcattgttctatgcttcatcaccagttacaagtggcatttgttcttctctatataaacttaacatagaaaaattataacctacctatctgtatattctacacaatataactgctaattttatcatcggtgagatggtacaaataattcaactgtcaaattagactcatatgaaatagaaatgtttaatcatttttaggatataaaagtctagtgtctagaggctcagggagaactaaggtgagaggttgagtattcactggatctcttcctactacgataaataagttctgacacattacttacacaaaagataaaaagtatcagtaataaacacttccattttataatcaaataggcacaaaggatgcataatattttccaggaagcgatgccccatatatccatagattctagggttgctttttttttttttttaacacaggagatgctaaacaaccaagtacatgctgctaaaaacaccttgcagataaaaaccctcccactagctaacgtaactagcttgtttgcaaaaagtctgcttttagcatgtttacaaatgtattagtctgctagggctattataacaaagtatcatcaaccaggtggcttaagagtgggaatttattttctcacagttctggaggctagaagtctaagatcaaggtgtcaacaggtttggttcctcctgcggcctctctcctttgcttgcacatggctgcctccttactgtgttctcacattgccttttcttgatgcaagcacttcactggtgtcttttcctcttcttaaaaggacaccagtcctattggactagggtcccattcatatgaccttaattaaccttaattacctctttaaaggccatatctccaaatgcagtcactttgcgggttagagactcaacatataggttataggggaacttgatttatttcataacaacagggatatgacttttatttccttgtcctctatataaaggaagagcctagatagcagatctgcttcccatcctttttttctcaacgaagaaggatttatgttttccaaaaacaaaaaaaaacaaaaaactcttgaattttatctcacgagagcaaataaattcaatcattcagcccctaaatgcctcaaaagtctgtagaatagagcagcttcaaaagaacaagtgggaagtaatgaggaagagtaagagacaaagcttcacaaaggctgtgttaaagaagaactcttactcctagtgaattctgagatgatatcacagactcaatttatatgcaaacctgaatttaagtgtactaaaaatataaaattcactttggagctaatgaagtaacttttcatccaaaaaaaatatattactttaagtatttctcctgtagtaaaagtatttaccgttttattcatagctttggattgagcaaatatatcttaagatatatgtgtcataatatagactataacataaaatgcgggtgaacacagtaactcacttttacatcataatcaagtcattagcttctcatttccgcaattaaaagaaatatgtcttatgagctattcaaaatcttaggttagagaaagttaccaagtaattagctgccattctggacacacagaaattagagtaacaaaaccagttcacacatagatacattctttgagagacagaatagtggattaaccacaaatataaagtagagaatgcagagaatgcccctgatggaattctcaagaaaacaatttctagtgcacacagttggctgcctaaccctcttacattttccttatctttcttttttttaacagaatccatattttattcagatatccattctatctgtaaatcgtccctgtgtttagggaaagatcagctttatccatagaagggatatctgaataaaataaacagaactccccagttccagagttgggcctcagttactcttagacaatgtgggtaattattttcccattgctcctggttgtttcaaaaaatcagacatacatcagtcagtacctgtgtttgtaaattgttatctgggaataaccagacagtgcaaatagtttctattataatataaagaaggaaagacttctattcataaaaggggaaaactctttcccttgtattcactggatttgaatgagaaatcctgtactgctcattgctcttaccagccattgcatactacaaggggaagcagaagtaggatgaagctaataggtgaactgcagggtggagaggcagaaagaatgtgcttccttgctgagatctctgaaccataaatcaagcagagctgaaaacttttctacctatctacttcaaatatataatatacaatctcttcattgtttaggtgggctttatttgcagggtataagctgtaagcaagtactaatactttataaaagtatttcataaagtagtttacagtaactcaggttgatttgtgccgttaaggaaaaaacttttacttttttattactaaaaatgtatgtaaatctcactggcactgaatgcatttttcaaacaaagaggcttgaaatggtgaacagctattcttttctgcctactagggatgagaaagtacaggctgttttcaaattaaaaccagaagggccaaagatgtaaataaatgtgactgatagaggacagcataaaagaaaaaataagtttttttttttaaagcaggactgtgagaattttaatagagtctagattggtgaataaaaaagaatagaatatcccaaaaagtgtatattaatgctcaaaccagtaaagaaatatgagttaccactttgtggaaaaataacatgggtagattcatatgcccctactgcgtgtaagattatttttaaagagattaaagcattaaatgtagaaaataaaaccacaaaggctctagaagtaaacataggacatttcctttataacctttaagtggttaaggtataagtaattataactaaaagtctagaagctaaaagattaaaaaatgggtatatgtgaatacagtaacaataacttcatgaaaaaatattgtaaacattcacttctcagtcttttggctaagatcaagtgaaatattgtaaacaaattgaaactacaagtaatcaagtaaagaataatatttactcttcatatagtataatttctttactatatgaagtgtttctagaaatttatgagcaaaagactcaaactcaaaagaaatataggcaagtatataaacaattgatagaaagtaaatgcaggccgtcgcggtggctcacacctgtaatcccagcactttgggaggctgaggcggtttgatcacgaggtcaggagatcgagaccatcctggctaaagcggtgaaaccccgtctctactaaaaaaaattaaccgggttttgtggcgggtgcctgtagtcccagctactcgggaggctgaggcaggagaatggcgtgaacccgggaggtggagcttgcagtgagcccagaatggcgtgaacccagaaggtggagcttgaagtgagccaagattgtgccactgcactccagcctgggcaacagagtgagactccatctcaaaaaaataaataaataaaataaaaataaaaaattaagtaaatgcaaatgacttttaagtatacaaaagtgtattcaagttcaaccataataaaactacaaataaaactctatcaatattctttcacttattagaatagcatatttaataacacaaacttcagcaaacatatagagaagtaggtactaccattcatgcatccacatgattggagtataaattagtacatatttatcaaataaaaaatgcatgtgtgcatgtccaatcaattatactctaggcagattatcctaaataactacttacatataaaacgacatatatgactatattcattgcagaaaaatatataagaacaagattctgaaaacaacaaagtttttaatatagtacgacttaatgatgacacatccctttgatgttctgcaatagtaaaaatactgaaaattttctatatgtattaacgtggaaagtttttcaagataaattgctaacgaataaagcaatgtgccaaaaggatacgtgttatgctgtccaaataaaggaaatcaataatgtattttgttatctcttatatatacataaaatacttaagacaccaagaagctgttgttaagaggtaagaactgggcagacaatagaaaaggatagaatgtggaattttccaattctgtatcatgtaaatgcatcacctgttcaaaaaataatgttcacggttccctacattttctgagaaatatccaactctttagccagtaatttacagcctttcaaaattgttccggtaatatttcatttttcttgctcatgctaaaccaccttctcatcaaactattcagtaccttaaattctactaaaatttctttgtggcatcacacacatacccatttcgatacactctttttctattatcacctgtagaaacctacataacttcacagcacatctcagatgccagctctttcaagatcttctctgataaacccaaggagaaataatttttccctcatcaaaatccttagtgcacttgggattacatcacatattcttcttataggagtggtctttctattagcattgaaggtccttaagagcaagattgctttttaaacatctgtatttcttaaagtattctgtgcaaaatactatgctaaaccctgtatttactcaaacattttagcttaatgaattaaaatatgactcaaaatggaatggtaagttgttccatcttaatatattaagaaatatcaccaacagcaactacatcaagaaaccaagaagacaaactttaatggaatatttgatggacgctgaagtgagtctattaacaaaaacaaacaaaaagaatcagggactacatttgccattaattctaaaattgttgccatttagggcctcactgaaatatagggccaaatagctgttgctctaccagtagcagttctcatattaaatgatgaatttgcaaggcatgccccctaggatttcatctgttctccttgagaaaatgtcaataacttctataaagaaagagtggccctagttagagttttttagttccaagtctatgtttaacccattaagaaataattcatacttagtatatatttttaaaaaacactaaaatatagtctaaattttcctgattttttaaactatgtaggaattatataataaaatgtgattacctaagagaatgttctggtttttaggacatatacaataaagtacttaggattaaaataataagatggctccaatttgcaaatagtatagaaaggagagagagagagagagcacactaccaatatattcaaatgtaatttagaaaaaaatctggataaaagggtatataggactttcttctactattcttgcaacttctttctaagtttaaaattatgtcaaaatggctgggcgtggtgactcacacctgtaatcccaccacttcgggaggctgaggcaggtggatcacctgaggtcaggagttcgagaccagcctggctaacatggtgaaaccctgtttctactaaaaatacaaaaaattagcctgaattgatggtgagcacctgtaattccagctactcgggaagctgaggcaggagaatcgcttgaacccaggtggcggaggttgcagtgagccaagattgtgccactgcactccagcttgggcaacaagagcaaaactccatctcaaaaaaacatagtatataaaaataagagttacacacacacacacacgttaatgtccaaccaggcaaactgagtctatgttaaaattcggtcatcacctgtaaactagttcaaccattgtggaagtcagtgtggcgattcctcaaggatctagaactagaaataccacttgacccagccatcccattactgggtatatacccaaaggattataaatcatgctgctatacagacacatgcacatgtatgtttattgcagcactattcacaatagcaaagacttggaaccaacccaaatgtccaacaatgatagactggattaagaaaatttggcacatagacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaactgaacaatgagaacacatggacacaggaaggggaacatcacactctggggactgttgtggggtggggggaggggggagggatagcattaggagatatacctaatgctaaatgacaagttaatgggtgcagcacaccagcatggtacatgtatacatatgtaactaacctgcacattgtgcacatgtaccctaacacttaaagtataatttaaaaaaaaatctcagaaactagagtcagaagaatagccaaaaaaaaaaaaaaaaaaaaattcagtcatcactatctttaatggatggaatggagtttagagtaaatagtgcagggaaggtagggttatgaggttttagtgttctctttcttaatctgcattctgattaccagattattgttcacttgataaaattttatcaaattgtgccctgataatcagaatgtaagaatgtcacattttctgtaagatatccttcaatgaattttaacaaaaatattatgaaaaaataaatttctcttttttttacttgattaccctattatagaatgcatatgtttagtgactttgtatagtgataagaaaatacctcaaacaggattttaaaaaacgtaaaaagatgtaaatgacacttttctttattttttattttatttatttatttatttatgataggatctcactctgtcacccaggctatagtgcagtagcatgatcacagctaatttcagccttgaccttctggtctcaagtaatcctctcaaggcagcctcccatttagctgggaccacagacacgtgccactatgtctggctaattttttgaatttttggtagacagggtctcactttgttgcctaaggtggtcttgaattgctgggctcaagcaatccttcagcctcagcctcccaaagtgctgggattatacgcatgagccaccaggcccagccacttttctttaattgaagtgctatagccaataccaaagttgatggcctcccatccaacttacaatttacagtatagcacctatacatttagtctgctgctctaaatgtctcccagtaatcaaactgtgtgtgaaattcatagtatggggcatactattttttaatcattctaactactgtaattatgtccttatctgtattcatgtcctgaaagtttatgcaagtaaaattagcataatgacatttaagttatttcatgtttatgtgcatgcatttactggacattgctattttttacaaccttacattttaaatttctacttttcatccaagaactctctcaaaatgtttgacttaccttcttttgtttttacatttttctgttcttcaattttttcattcatccaacatatacttaaatatctaagttttaaggtaactatatgtgccggtatatttgcctataaatcatcatgcacatagaaaacacttttagaagcttcctctttcataccaaattcaaaccataaggtctaaaggaagtacttagaggttgtggtatacacacatttattttactgaaaactgaaaataacgcagacaaaaggatgaaacttattgggaattggtatgatatataagatatctttcactcagaaaaaaagtaagaatataccatactaagttcattttcttcaaaaatttggatcctttcattttctagggctgcatatcctttttcctaaagaggaactccacattttataagttgcagttcccataaagactagatctgtccctagttttgatgaactatacctgggaaaccagaggtatggcaatcctaaaacgaatataggaaaagagttccaatagacacagattcccttcccctggtgaaaatgaagatagaaacaacaacaaaaaaagatattatgtaatataaaataaaacaaatgttcattatatttgaacctgtattctcttttctaaactgagtttcagagggcaaggaacatgtctgtcagatactactttctatccagtatacatagtagctgcacaataaacatttatgacatgaattaattagcgtttctctggcctgccaatgccctgtatatagaaaatctgtaaatttccactaactttaaaaatactcatattttcctggaacagaaagtaaagattacatggcagacaaaattgcatctgtctactaatgattaccatgtaatctttactagatggccttgtggttctcagtaagagtcaagtgacaaaggagacagagggagcaaagctgaaagactttaataaactctctttgcaaataatgtttttattcaatgtcaacttcttattaaaacatcccaggtcttgactcttctgagtcttttatatactttttttctacaacaaaggagaaagcaatcactattgatttgggcacatatcaaaaaatgaaaaaagagaaataaataaatagttgcatttcaattgtggccaccatacagctaatagtttatcataactcttaaaggttggtccctaggctcttatacaggttcaccctttgctgacctcttacaatctttctgtcagcattttgaatgctactgattctgtgagtaatattttcaacggaggtcagacaggccagtaagtccagcgtgccctctcacttacgaattccccttcttttgtggcttttcaccatgggttcacatgtcatggactctacatcgcaaactgcagtaaacaaatttcaatcgtgagtgaaaggagaaaaaagcaaatcctacttgactattgctagcttgtttacaccatagggctagagtaagctgaaatcgacagagtataaagaaaagaaggtcctcttgaagtaacacacacactcattttcagactcatagtttaaatgcagtcttttatttgtcactaccactgcattgttatcagaggatttatatgcctagagctgccagaagtgtcaccagctctgacaatgcccattttggagctttttccgatggcttattttatttatagtcttgatgaaactggggcagtcacaaaactgattagcgatctggcaaacagggcctgctctgctaatgatctgtgtaaatattgtgctgtagagcctttctgtgacaggtcattgctgctaacaaaccgcagaatgcaaacagagacctgtgctgccttcactgcagatgcacagcagccagcttacactgacaaagcaaatgaaaatcctcttattgtcgatcatctcaagcaaaatggcctaaaaatcaattctaggataggctttctttctttctcgaagctttaatctggggatgatgacagtgataatggtatttcattatacacataaagtaagagagaaaaacgtaataaaacaagatataaaagatgaatttaaacaatggattgtgaaagccttgctgtttgcttctgtttttaaaaatattttgctattttttcttggctgctgccgttactacagttgtagtctgcacagaatgaagccttaatcacacagtcatgctgaaacatgtttacaaaggtaaaattaatgggtttatcttaagcaagatgtctttctatggcatcattaatatgctttagattttttaaataaatgtgtttttattcttccagtacatcagaattggaattggagtcatgtcaagatgttctcactggcaaagacaggaggaggttaaaatagctccttgtagggcagtaacctcgggagaaaaagaactaatagaaaataaatggcgagtattttttttgaatcatttgtatgataagcttataatgtacttgtctcaatgcagaaagcacaaggaaaaaataaatatgtcctcatcacattggtagacaaagcactaagcacgtaggttgtcagaaattcgatatccctttctcttttctatatcctctaccaaacagaaagttccacatacatctgagacttcagtgtctatgtgacttgagtacaatttcctttttcatctttgtttttcctttacttactcgtttccctttattcttacctgagatatagagaataaaaaataacactatagaatcaacctttttttctaggtaatttagaataaattttccagaacataaaaagggtaatgatggcattatgtaaatttgagaccaaaattttctgaattaaattatttttacatagataatggttcacttctgattaggaacattaaataaaaagtaatcttaacaatatgacaatacaacttagccttcttgcattatcttttttagcctaaatatttaattattataatttgcacaacatcgaaattatagtgcaattcttttctttacaaaataatcacaataaagtattttaatcaagcaactgagcacatacaattattattctatgtccataaaatttttttgcagaaaacatttatataagaatttcagtagtcaaacattgagtagcaggaaaatactattaaattttaaaaaccaaacaagcattggaaacagaaaaatggatacgaagagaagcaagtattctcctgtatttataattgtggtactttacaatatatgtaatatatctttagaaagattaattgtcttttattctcacagaaattctatgagccaggcagaggaactgtttttgttcccattttacttctgtaaaaactgagtctcaaaataactgctccccagaagtatagaatgattaaaggtcagaaacagagcctgcatattttcatatttgttacacttttttagctattgttgtccaagagtactcttacttttgagatactttctttatttcactgttcagaatttttatatttgtatgatttaacaaaataatcggtaaatttcatttttggggattaaaaattaggttgtggaagctacattaggttgtggaagttgtgccccatctgagacaaatcttggattaatcagtgattgattaaattattgaaagtttagttattcaaagaaattggcatagaagtacattaagctaagctttatctggtaagatggagaactaacatgatgtgggcttctttctgtgaccacaaccctggaaatgacacagaaatcagcatctaatactaaaagatgtgagaaacctttgcagttacaaactacagtaaagtctgcgagtagagaaaaaaatgacagcaaagagcagaaaactgagatgtaaggaaaccagaatatgctggggcggaagtttttagtggtcatcattccttttcattgcattcctgtatttttttctgctctttcaatagttagagtacccacagtgtgcaaggcactcttctaaatactgagaatacactacagagccagaaagacaaaactttgaccaaatggagctcccattctagcaaaactagagttgaaaagagaccactgctaactcctttaaagccattttggagtcggccaggcagaatatgactcaacctagcttggaaaatgaggaaatagtgacaaatgcagaaagaccatctgaaccctaggcattctcctctaacccagctactccatacaatgagtgttaggatggtgattaaaactgagggagaccagtcttggtaaacagcaccacccaggacacgtgaatacaccaacttttatggaggaggaaggcaaacaaagggtggcagaatccagttatttcctaaggagtccttcattctaaacacttctggtgggtcaatcttgagcctgattttagtgccatgtattcttaatcagcataataaatcttactaggaaaaaataggcctcaaaggaattcaatgactctaaaataaaatacatgtatatcaaagacaaccagatttacaaaaattaacaatagtttaaaatatgtgaccatatgtggtggtttacgtctgtaatcccagcactttgggagtccaagacaggagcattgcttgaagctaggagtttgagatcagctcgggcaaccaagagagcccctgtctctacaaaataaataataatttaaaaaaatacctaggtgtggcggcatgcacttgtagtcccagttaccaaggaggctgaggcaggagaatctcttgagcccaggaggtcaaggctgcagttagctaggaggctgtcaccactgcacttgctccagcctgagtaaccgaaagacactgtctctgaagaaaaaaaaaagttaaaataaatccaaaaatatgtatagtaaatgttctcaaagacataaggcacaatatttgaacctgaagaagaaattagcaatcataaaatattttttcagtatgaaaaccatatctgttgaaatgaaggattaaatatatggtataaacagcagaagggttaaatttgaggagtgctcattagtgagatggaagataatgttcaaataataacaaatttttttttaaatttagaaaactagacttcacatgtactgctgatgggagtacagactgatgcaactatccagagagcaatgtggagtgaaatgaaatccaaacctatgaaccagcagtcctactcttgatccacatggcaaataaacttaagtttaaactcatgaaaggatatgatatccagtagagacaattgttgttgcaggaagttggaaggaggcaaagaatctatcactgtaatacacacacacacaattgtttataaaaatggaatacaggccaggtgtggtggctcatgcctataatcacagtgctttgggaggccgaggcgggcagatcacaaggttaggagtttgagaccagcctgtccaatatggtgaaactccatctctactaaaaatacaaaacttagccaggcgtggtgacacgcgcctgtagttccaggtactcgggaggctgaggcagaagaatcgcttgaacacgggaggcagaggttgcaatgagccaagatcacgccactgcactccagcctgggcaacagagcgagactccatctcaaaaaaaaaaaaaaagaagaagaagtaatagtgtgctgtgcagcatgaaaaaaaaatgaggtaaagatacacacgataacaataataggtcttaataatatagtgttggatttacaaaagtaaaaactatatatacaacatataactcaaaaacaaccacaaaattttatagttttcaaaaaatgcatattcaagggtctaccacaaacacatgaatgcaattgaagtaagagggagaagcagaaggaaataaaaatagagattagagattagggcaagataaaataattagataaaataaaccaagaaattcctattttatttatcatgataagaatgtactttaaaaagaggatgactacataaaatgagttagggaggagtacctctttttctattgtttggaataatttcagaaggaatgataccagttcctctttgtacctctggtagaatttggctgtgaatccgtctggtcctgggcctttttttttggttggtaggctataattactgcctcaatttcagaacttgttattgatctattcagggatttgacttcttcttggtttagtcttgggagagtggatgtgtccaggaatttataaattttttctagattttctagtttatttgtgtagaggtttttatagtattctctgatggtagtttgtatttctgggggatcagtagtgatatcccctttatcattttttattgtgtctatttgagtcttctctcttttcttctttattagtctgggtagtggtctatctattttgttgatctgttcaaaaaaacccctcctggattcattgattttttgaaggacttttcatgtctctatctccttcagttctgctctgattttagttgtttcttgtcttctgctagcttttgaatttgtttgctcttgcttctctagttcttttaattgtgatgttagggtgtcaactttagatctttcctgctttctcctgtggacacttagtgctataaatttccctctaaacattgctttagctgtgtcccagagattctggtatgttgtgtctttgttctcattgttttcaaagatcttatttctttctgccttaatttcattatttacccagtagtcactcaggagcagcttgttcagtttccatgtaattgtgcggttttgagtgagtttcttaatcctgagttctaatttgattgcactgtggtctgagagactgtttgttattatttccattcttttgcatttgctgaggagtgttttacttccaattatgtggtcgattttagagtaagtgtgatgtggtactgagaagaatgcatattctgtcgatttggggtggagagttctgtaaatgtctactaggtatgcttggtccagagctgagttcaagtcctaaatatccttgttaattttctgtcttcttgatctgtctaatattgacagtggggtgttaaagtctcccactattattgtgtgggagtctaagtctctttgtaggtctctaagaatttgctttatcaatctgggtgctcctatattgggtgtatatatatatatatatatatatatatatatatataatcgttggcactccttgttgcattgatccatttaccattatgtaatgtccttctttgtcttttttcacttttgttgctttaaagtctgttttatcagatactaggtttgcaacccctgcaaggctacagtaaccaaaacagcatggtactggtaccaaaatggatatatagaccaatggaacagaacagaggcctcagaagtaatgccacacatctacaaccatctgatctttgacaaacctgacaaaaacaagtaatgggaaaagtattccctatttaataaatggtgctgggaaactagctagccatatacagaaaactgaaactggaccccttccttaacaccttatacaaaaattgactcaagctgcattgaagacttaaacataagacctaaaacattaaaaccctagaagaaagcctagtcaataccattcaggacatagacatgggcaaagacttcatgactaaaacaccaaaagcaataacaatcaaaattgacaaatgagatctgattaaactaaaaagcttctgcacagcaaaagaaactatcatcagagtgaacaggcaacctaaagaatgggagaaaatttttgcaatctacccatctgacaaagggctaatatccagaatctacaaggaacttaaacaaatttacaagaagaaaaaaaacaatcccatcaaaaagtgagcgaagcatactaacagacacttctcaaaagaagacatttatgtggccaaaaaacacatgaaaaaaattcaacactgggctttacagaaatgcaaatcaaaaccacaatgagataaaaatgatgaattcatgtcctttgtagggacatggatgaagctggaaaccatcattctcagcaaactatcggaaggacaaaaaaacaaacactgcatgttctcactcataggtgggaattgaacaatgagaacacatggacacaggaaggggagcatcacacaccggggcctgtcgtggggtggggggagggacgagggatagcattaggagatatacctaatgttaaatgatgagttaatgggcgcagcacaccaatatggcacatgtatacatatgtaacaaacctgcatgttgtgcacatataccctaaaacttaaagtataattaaaaaaaaccacaatgagatgccatctggcataagccagttagaatggatatcattaaaaagttaggaaacaacagatgctggagaggatgtggagaaataggaacgcttttacactgttggtgggaatgtatattagttcaaccattgtggaagacaatgtggtgattcctcaaggatctagaaccagatatatcatttgacccaggaatccctttactgggtatatacccacaggattataaatcattctactataaagacacatgcacatgtatgtttacgcagcagtattcacaatagcaaagacttgggaccaaaaaaatgctcatcaatgacagactggataaagaaaatgtgaaacatatacaccatggaatactatgcaaccataaaaaggattagttcatgtccttcctggggacacagatgaagtgggaaaccatcattctcagcaaaaatacacaggaacagaaaaacaaatatcgcatgttctcactcataagtgggagttgaaaaacgagaacacatggacacaggcaggggaacatcacacactggggcctgtttggggtggggagctaaataaatataaatataatttaaatatatacataaatataatataaaatgttatgactaaattctttgttaaataaaaagtgaatgaacaagtaaacaaatgaatcaataaaggtagatcagtaagattggacctgttacgtttctgatacacttctgtcagcatctatgccaagctttgcctaatcaccttaagctcccaatggtcccaatttctttattcttgacaaatgaactcatttctactttattgaaaccatcagtgaccatctataaagagctcctttatgtacctataaatcatcctagctcacattttcctacatttgaaatcacccattcttgaattttcagtgcccattgtccagactaacttttccactagaactttaaattcaatcaattccttttatctctagcatcaaatattctctatcagctttaagctgttaatcctctgtggttcctcctgtactaatgcagactcatgctagtccattccaaaagacctccttgatatggctactattacatagtccttcctttattaaaaatatttcatctctaactccctattgtaacaatgtgttgttatgctttaagtttcttcctaaaatttttcattaataacctactaagaaataaaatatactaacttatagtattctgtgactaagatatctaaagtttggtttgatagtccatttaaggagtagattttcccatctctctctttgggaaaaggaacctagccaagcccagatttgtgtgtctatgtgaatcagtaacacttcaggaaggaagtatgacatagtggttaaggtcacaatctctaaaatcagacaaagtatattcaaatgtcaatcttagcagttattaggtatgtaaagttgaagaatttcattacatcttctgatacaattttctcatctgcaaaagtgtgtattggtagtataggcattatatttttgtgaaaattaaataaaacaataaatacaaagtaatatttttagtgttaggctcacagtaaagtgttactatgtattattgtcatttcactgtggctcttatttctgaaggacaggacagtctactaaatgtattgtaatgtaatgaaaataactaagccatgttattctattattttgaaaagtatctctggtttttcattcattaaaaaacatgcctctcttttggggacactccattgtccttttcttctagtcacattgaagtctgtttgcctttgaaggcagccacattaactcactgtctacagggaaaaatcgcacccctttttatgggaggaagtacagatttttgattcctgagtcctgttaatacaagtagcacctcagactttacctagattgatatccctctttctccatttctcagcttgcaaaatggagtgggcaattgtttaaggggaaaagtgtatgtgctttcaaattccagttcacttctcattagtgaaaactgtggattggtgaatacaattaatctcctgaattatactttgcaaaaacaaccaacactttttcttagacacaatacaatgcaatttcatactaaagaaagaatgttacctattagcataatcatgcccattattttaataacaataaatggatattcattatccatttttgtgctgagaatcatttggtgttttattcctttcctatagacctgaaggtatcaaaatgctacagcagtagtaaatagtaatctttgttgttagagaaagaggcaatggttttgattacattctggtttgaggtaatctgattgtgatagcatgtttggtgagaaatttgtgatcaatttctttctaacattattatttactgtaatatttttaaaatctatcaacctgtccttttaaggcttctataacatgaacctatcctgaatatttttgtttctgtctaatgctttatttcttttcttgatttttaactttccatctaaaccattactttttctcaaaatagtgtaaaccatcatctctatgtaaatgagtatactaaaaatacatcataatacctatcctgagatccagtctcaaatttccaacttttttctggccattttcattttttactttgttttatgtataaagaaaacaaacaaaaactagcaaaaacataaaactggctccagctcttatgccaggtgctatgagtaaaggacaaagttcctgactcaagtttctcctatttatgtcaaaggtactattgtcaaactgatcaaaaatttgtggtcacagacattgtcattaccttggtttgcctatgcctactcatatacttaaattctttttttcaatgatttctcaaatttatttctactttctttaccttctgtgacccttacacttaaaaggtgaaagtggaagacagtcttttgatttttttttttgaatgcacaaaatacatgttattccctgactctccttttgatggatagcccttttttgagcaatttaaaatcattttctttttttgattatttatgaataaagttcaaattctcacatctaatattctaaatccttcataatttgtcccaacatttacttctaattgtatattcaaatattctgaaacaatcacattattctaatgtatgcattctatacttctgaatgttttctatgcttatcaccaaatttgcacttgtcttttgaataatccataatgcacttttcctcttccccatattgttgaagagtatcacataataggaagctctattaacctttctttgatcatcatggtccacgatggcatctccctccttagaagatccccaatatatattgcatagcacttttctgaaagttacttttttgtgtttatgtttcttatgttcagacttggatattaagtgacctgaagataaaagatctgtattctacatcttctgttcacacatagcacttactgaggaactatacacatagcaattctataaagtagggagtgttttctagaaaagaagtgactatgtgttgatacgtctccttcaattttattaataaactttcatttacgaatatgtattaaaagtgtctttaggctctctttgtatgtttgacccatttcgtggtaaatgtgaacagtggaacaagatagttgcagtgctaaacttagactaaagggaagaggaactcaggttctaggccagccctttagagtgaaccacaaaccactttcaccttcctcccatgggggctgggaaggagagtagaaggggaagtggcgatgagtccacaaaacaagtgaatgtgctcatgtgaaacaagactcatgcccatccatgtgctatgccaatgtaccaatactcaagactctggattcctctttaggagaaataaaaggtcctaagattgctttcaaggtctattcaaggccattccctacatcagcctttttgaaggtggactggtgtgtacaacccttggtcaaagggatgtctcatgaggagatgctggacaaataggctgcagtatcttggatgtaacaaacccctcatccagcaagatggaaagaggggtggaaagagaatgaaattggctatgacctggggcctctttccaatcctcacattccattgtggacctctcttggcagtccaagaatgcagatttcaatttaattttttaagttgttatgaagttgtcaatgtaggaatttcaatacactttaacagttcttaagcttgattgatgtcttataaatatgtagtcattaatatgtgggtctagatttgcaatacttctgaacttccacaaatgttagggacaggcctgaatagctaacttttttcttttatttcaagttgacttaatattataaaaaacattttattttttcctttaatagagtcaagtatacagtttctgttttcatccagtaactttagcagagactttttctctctgctagtgaaagagaggactcaggtttagaggaaatttgctttttcagaacatttgatcttcgtaacacatcaagatgtatttagagaaaagaacacacggacttagtactatttataaatagcttctttacccttactcctaaattaaaacaaaactaaaacctaggaaaagcacttgcattatacaaaatttatactttagctatttctacatttaaaaataaaataatataaatcaccaattttacgttttaagcaaaagtgtattctcaaactttatattattcagcaatacctattactctccaagtatatgcatgtatcatttctctcatttaaagtctctgaccacatctagaaaaagtgaaaaatggtgcagtcattacattttggttttggaactgggaattttatttagcacaatataaataattagggagtaattccttttatactatttttcatccactttttttttttttttttttttttgagacggagtcttgctctgtcgcccaggctggagtgcagtggcgcgatctccgcttactgcaagctctgcctcccgcgttcacgccattctcctgcctcagcctccagagtagctgggattacaggtgcccgccaccaggcctggctatttttttgtatttttagtagagccggggtttcaacatgttagccacgatggtctcaatctcctgacctcgtgatccgcccgcctcggcctcccaaaattctgggattacaggcgtgagccaccgcgcctggcctcttttttttgtttgttttttttaaccatttctgatttactgaaacccagtctgtatttaataaggcttaaacatttgtatgtttaatataacaatatgtcctcagtggcagcttgattagatttggattttaaaagtcactgtagaagggaggaaaaatatcaaagaagggatacatactggtgacaaatacttttaaaatagcataactcaagtaacgcaagtcagtctcgccagccaaatgaaaattataggtggaaatctcacactgaacctggagaatttcccgttcctgttaaagtattttcttactgatgtattcataaaacaatactgtccatttatgtctttcagaaaccattctattattttcattaacatacctgtatattagaataaaaactttacaaggttatgttttcattttccacttttttttcttgtttctgtattactttttatatcagtttaattttggcatttaacctagctatctaataccttggcagtaaacacatttcccacccttgctcttgaatataatgctgtcagagagtgggatatgagaaaagcaagaggttttctaaaaggaaaatatctatctatctatctatcatctatctatctatctatctatcatcaggaggacctagagacattataaaagaattaaattcaaattgtaagatcataataaagtttaacacatcatgatttataaactacagatataaactaagtaacttgtttaaagctccaggtgctgctttccataatattttaagtgaaatactgtgtgtataacttaaaaccattaggccatgaagaccatggagaatattttaagaatcagtcacaatctgaagtgacattattgttttttgtttcagtacacattagtaccaatagttaattttaatttgtggaatgaatcagtaaacaataaaagggtatgaaagggtaaagcacaatttaaagtgttttggaaaatgtggtcagaaaacaacataagatcagtagaataattctagcatatccatcgaataattaatattatcactatagtaaacatgatttagctcacactatttggcgaaaagaaaattcacttgcagtattctgcacattgtgttatttctgctcaaatgacatacttacaataatttgattgaaatcatgtgactctcctgaacaatcatgttctatcttctggtttaaggctatgtagatattaagagacatacagtgatccatcttctttgtgtggaaacgatcaaacactacaagtcagttaatgtgttttcaatggtgaggggttaataccaaaagatttatattagaattgtatagcatctatatttctaatccttagttatttgtatgaacaattagaagtctgacctgtttggaacttattttggggtaaataggttcccaagccttcttgcaaaggacatgcaaataatgaaaatatgatattaagaaccactccactgttattaaatgaagatgaaaagaattaaatcaaagtctgccatagaataatttatagataccatattgaacattttctaaatatgcccacattcttggagtggcagataatgtgttaacattataataagcatgagttaataaacattatgcatattctctactacagatgagtatactttttggcccttttaatgaaggatgggaaataagcaactccctgtaagaagaagaacagaaatggatccatttttgacttgaaacttttataaaaatagctgtatttaataatgttttacttatcatgggtacattttttttaacttgtgttcataaggtagattcattcagcaaaagagtaaccggtactagaagagaagtaagaaattcatggctgagttaatatagttaaactatatccgtctgaaactctttctctctgaggaagcttttaaaattatttttttcatttttccagaccttttttcttgatctctgtattttcctctaaagcgaagactatcaatgacattcttaaactttgaaagatttaggatgaagggaatatttacttatattttagaaatagtgcaattttggagactgagaagtctctcaggttattatcatcaatgtagaacttaccagagatgactttggctttctaaagcatctaaaataagctatagtatgcccatgttcctgcagcattggacttacataatttcaaatgttaataatacctttcatggatgcctttacaggtatgcataaacaaaatatctcatttttttaaatcattctgccctccatatgaaactattggtctattagatatatttttattttttaactgttgatttgaaattattatagatttacagaaggttgcaaatatagtacagagaggtctctcatactcttcacctagtttccccagtggttacattttttttgtagctacagtaaaacattaaaaccaagaaattgatattgaaaaaatgtgtatgcatacatctgtcattttattacatgtgtaaattcttgtgaccactaccactatcaaaatatctaacacttctagtgaagtgtaaaaatcttatctcgttggaagtctctttacccatccttgtttatataattttaaaaatttttcatttaggtattgataaccatttcgatgttacagtttttgattcaaaagtcaaacataatttagaaaactcaagaagaaaaatctgttgtacttattcatatttttgctctttctgttactcttacatttttctgatgatttcaggccccttattcattttatgtttcaagaactttttgcttttctttagggtaggtctgtttgcaaccaattcttaatttttcttcttctgagaatttatttaattctccttcatttctaaaggacatttttgcctaatacagaattctggtttgacagttcttgttttgcagtacttgaaaaatatatcacttccttttggccaccattatttctgacaggaaatcattgtcattcaaattgtttttcttctggagagatgaagcattgttttacctcactgtttccaagattttttcttctgctgttttctgaaattgacctgtttctttgttgatttttttgtatctgtcccgttttagattttctcatttcttgaatctgtagttgtatgtcttttgccaaactcgaaaacgttttggacattattttttcaaatatatttttagcccaacccacttttgcctttccttctaggactctgatgacatgaatagtagattttttgctatagtcttataggtccttgaggctctgttctttttttttttttcaatttcagtctatactccctctggtctttggattagtaaatttttaatgtcctattttcaagttcacttattcttttctctatttcctccattaccctattgagccatcaagtattttttaaagtttcaattatatttttcggtgccaaaatttctatttgtctcttggcatcttctatttctttgtaaagctttccattgtttcatttgttccagcatattcgcaattgctcattaaaacatttttatggtggtggctttaaaatccttgtgaataaatctaatttatgtgttatcactgtgttggcatgtgttatctcattcaagatgagattttttttctggtgcttgatatgctgagtaattttcaacgtatctagggtaatttggatattatgctatgaggctctgtattttaactcttggaaataaacctcctgtgacaccacacatggtgaaagtgggggtgccttgttattgctaggtggtgataaaaatttatccctgctcaaccacctttggagagtgggggatttttttcttgtttctgctcccactatggcctacactgaagggaaggcaaacatcaggaggccttggacctttttaccactagatgatggtgaaagttccaacttctcacttagtttactttgacacctaaggaatctggtggagaaggacggggcacattgtaactacctggcagagaagaaagttctagattcccacacggccttctctgatatcacccagacattgataggcggcagggcctgttagtttgtgtgtgtgtttaaattacacattaccaatagtatcactttgcataaacctatactaaactaaaagcacggaccccacagaagatatgtaattaaagttatcttgtagtatgcaggtctttttcacagatgcattcagtgtgtggtttaaaaggaagttaaaagtttagttctagttaccatgctagaagaacctaataggtaaaggatgacatcatcaaaggcagtgaaagtcctctttaatgtctcaaggcttttcattgtgtatcacgaaattttggttatctgtttcttttcagtaaatatttagtctatttttctaagtttaatatattaggattttcattttcattaatccttagtgtttgtactactgatatttgcacatacagtatgagaacatacatttcaattgatcatttttaaaaaatttatttgagatatatcaaaagttctataccatataaaggaaagttattctactattctaaagcagctcataaaatacaatgtacaaataggacaaaatacatgcaagaagcgggagaaatgttcctaagcagctccactgatacagtggagatataatctctcctctctattgaatgaatttgctgagggtcggtgcatatagtagtcaatggaatacaaaccaataaaaatatgatagataaatagaatgaaaagtatccaagggtcaagtgctaaatctgttctgctgattccagctggtatttccttttcttctttaacccacatgaagacactctactaaacagtcatgtataactcaggcatactggttttcatttgtaattttcattttattgcactttcaattttcaggttttgtccatctttcttccccttggcccttccatcacttctgctacttgatgaattctgtcttaaacagtagctagaatataaacatttaataaaatattaacctgattgcttgccctccctataaacaataaaatgacatacatgaacaaatgacaaatacaatattttatgttgtgtttatttctacctttctccaaggcttcttttaatctttattaaagtttattatagcaaactactatcaaatatttccatgcatttaactggttattgtaacatcaacacaagagagcaaatgaaattgtgaagcttgtactttctattgctctaaggtgtctatgcagatcattatgtattcttcaccacaggtcagttgcttagctaccagagaagtagagaactactaattgaaagtattctgtattgctggcaaggcttgctgcaggacgttgaacttggaaacagcagagactgtgtcagataaaaatgttgcagaggatgaaagaaaaatagttgcagcattatcatactaggaatggttattatttactttatggtaaattctgcaaaatgctttgctgtgcttctgttttgtaagatattaaaattgattttactattaaggatcatttacacaatcagattaaaaatcagagttgtggcatctatttttaaaaagtaaaacagaacacaaaggagaaaaagaagaggaggacaaaagggaagaaacagaagcaacagcactaagttagatccaggtccctaaagacaagtaacaatatctgtatgaacttttctgattgcttattttattttgtaatgaaaacaaagaaagaggatgaggaggaagatgaggatgaggagactgaggaggaaggcaaggagagtaaggaagaggagcaagaggtaaaggagaagaaaagaaaaaagagagagagaagattattaaaaatcaaactaaatacatattggaaaaacaattgaaaaacaaaccaaaagtagcaacactaacagagcaatagtataaacaaatttattcaaagcattaattttatattagtctgtatcaggctttctaacctgtacattatataaaattaggattattttctctcttctttccatgtaatgtacaattcatgtatccatcaaaaatagatgagtggtcattgtgtgacatctttcacttaatagaaaagactaggtcagaaaagagaaaatgtccttcacaagaccaagactaagttggctcaattttcctgatagcttatttgctacaagaattctgatataattctgtatttacaggctcattctctctctcacacaatccacaggcatacaaagtgtgtgtgtgtgtgtgtgtgtgtgcacatgcgtttgacaaagagagagagaaaaagacttgaataactgtttcttatgagaattcatttgtggtaatggttgctacttgtatttctataaagattactcctagtaatgattgaaaaacaggacatatgttaattaaatgttcagtgactttatagttaaatatacatataatgcacattccaagtttttaaaaaaataacaatcaataaatagctaaatgttttaaatcataactggtcagaatttagttgttaatattcagataccatttcagtatcgtgtagagtcattatgaatatcatttgtctgcagtactctgaagataaaggtggtaaaacatgtgttagtcaatggtctacctgttatacagccttttaaaacaaatccttggcatgagattgtcatttgtctgtttctcataaaagctgagtgtagaacatcctaaaaatccagttcagcttttttattcttgttacatttctgcagaattttaatataactttccttttgtgtatttatgcctactgtttctatttacttacgggtggcctgaattttttatccagagataaagttaatgcaagaaagaatttaaaaatgtatggtagattatcaaaattcttaacttaaaaaaaggtcaaatccacctttgctacagcacacaacctaatcttatatctgttcatcttttttgtctttgttttaaaaacacatacttgataatcatattagatggttacagctttctattgctgcataataaaccagtctaaacatagcagcttaaaacagctaagtagcacagatggacctgctcatgattcttcaatctgggctgaactcagctgggtggctcatctcttccctagatggtgtcttctgctggactatttaatatgtttgtatttagaggcagctccatagggactggaggatcctagctggccccattcatatgttgtgctggaatgactagaaactaactgggtcttcctctctatcttcccagtctttcattcctcctggtctttttcatcataaggtgtctcatccacaaggacgctaacctagacatctttgcacagtggctcaaggtaaaagacagagtaaacaaaagctataaagcttccttaagcctaggactgaaacttatacagtgtctctttagctgcattctcatggctcaactaattcacaaggctaatctattgtctggttgggaggataatgcaaggacatgaaatcaaaggacatccataattcattggggactgtttggtaagaatatgagttaaggcttaaatttgttcgaacacaactggttctaaagcatcacattgttgtattaggtttccagggttgtcataacaaattacaacaaacttgatgacttaaagcaacagaaattgattctctcacaggtctggaggccagaagacaaatgaatgtgttggcagtattggtttccactggagacccagaaaaaacccattccatgctgtcagcaattcttagcggtttttgtctttccagtctctctgactctgtcttcacatgcctccccgctttttctgtgtctttctgttattctatctcttataaggacactcattagatttagaatttattgtaatagaggatgagcacactttattaccttattacatcttcaaagatgcttattacgattgaggtcagactgtgagattctgggtggacaaaccttttgggcaaacaccattcaactcttacgattttctatcaaaatgtataattttctcccatactttttcagtaatctccaccataaagaacttggatttagaacacttggattcagtaatctccatcataaagaacttggatttagaacactttttttccacatgtatttaagcaatatttctcaaagtatattcctgagaaaagtatttcagttattctatgagtaaaaagtttcttggtcatgcaattttggaaattactgcttactattaacacctcctggatatttgctttgtgcattaatttattaatgagaaatcatataggaaaatatgctaaaattttaggaagcacatgtttttcccaaacaccaataaacactaaatatcaccaattttattcaaatgatacctatcaacaccttacagaaaaagggttatgtgtaccaaaggtcctgatttgacctattgtgttgactacatgatatctgtttcaaaaatataaacaaaattaccatgagtattactaaacattttagtaatctgtgcccttgcaattcagcaagccatttcaactacctggaattttctttctcctttttatggataactcctactggtcctttagatatgagattagaggttattttccaaagaaagcttttcttcactccccaaagattcagttagttgttcttccagtgatttttatagctctctgttcttggtggtaatatatcactgaaacactctactgtaattaccttggtttttgttctttatttagtgttcaaccatatgcttgctgaagtttaggatgttattcgtcattgatttttaagacacaacagatatttaatcaattcttattaaatgaatagatgagaaaatttgacattgggtagaaatcctttaaaatattttgcatggaaatcactttttgctttcaaagtaatgtaattaaagacttttagttcccacagtttgcaacaataatcttaggaacttaactatttgttttgtgaatatctagcactaaacaatgagctagaaatttgataaaacagttcaaataatttttaaatctctttgactcaactagtcatgactgaattcatttataccattaggatattaacacgtcttttaaaaaacagtgttaaatggagctggtcaagctatgcattttaagaagaaaaagtactctctttttaataggctctgcataagtaaggctatcctctttttcatagtttttcagaaacaataactttgtcattttctatacttattgataatttccccaacatattaacaattaagaaataaagttatggcagcctaattagtcgagtcaatacaggaagtaaattgttaagacagtgggcataccatcttagttagtaagatatggacattcaaccactctctttccctaccctaagacacacacactgtcagagaaaatgttatgatgtgactgagaactttatgctcaaagctttccaaaatttcatatataaatattgtacttttatcaatataagatttcacactgtaagaaaacattggcataggaatcattctcttttacacagtttgaaaatgaattttaatgacacttatatctgataaataatataatgtcatggagtaaaagttattttcttgatataaatattttatcatttgagtatattctccctgaaatctaggtgtcagtttaacaaaatgcatttctcacttcactgaatatgactccaggataaataaaaaagaacattcatattcaaaaaaagtaatttatttacctagtttatcccaagatttatactgtcaatgccttcattacaaattaagggctaaaatatatagtaagttcctgaagctctaccaaatgttatctatactaagtagaactaaattaaatcattgtgttaactttttattcctattaaaggatttagtcttcttctagtttagctataataacaaaagcaaatgtacatccctggtttcttgccaattatagcttggtcacacctgcctaagtagtgttttataataaatacatggtaagtaaattagtatccaaccctcaggcctacatggaataaatttggtggggtacttctcccttgggaaaaaaaatgttgttagcattttttgtttgctagtatcctttagacctactacctataaaaacccctctaaatgaagactccggcagcatttcaataagctaacttccataggtttcttcagttcatgggggtattttcctcctttaatttgccagcagagatctgacatgaaaaagttcaggtgctgttttataatataagaaaacatatacatgagactccttgttccttgtcataatcacatgtacagtgctttaatttcaacaaatcatatagaaaaaagaaggttggtttaagtcatcatcacaaataaaaaagcccataaacctacacctatattgtggtcttgtaattcaccacttgtaagcttgtaaaacctaaaacttaatatgcctacaaattttgaattttttagaatatactcaatttgcttctacttcttccattggggttcatggctatcttacattgtaagacagttagtagacccagcagaaatgacttcaaaatatttctggtttctgtgaaagtttgaaaatctgttgactccctggttgttctgtttggaagccttttacgcgttgctttccctttcttatttctccttacacacatacaagctcttttcttgcctattgtgtgtacttggctgatcttctgggcacagtgcccagttggtttaatgtgtgcttattattgtctatagcattcctgattctgttttggagataggtattctatgaattattaatgattattatcatcctttagaatcaactttgcttttggaatttagaaacaaaagatgaacattgagccctatgggtaatcaccagcaatatcaaggccatgtccaatgcttgactgtaagggaaaggaatagtgaatatactgaagtgaacaaaacaggattactcctataaacagataaaattaacagaagaaaacttaaagttcaaaatgtattacttgaaaaaatgctcgtaatattattttaccatacccattttaccatttaaatattaccagtagtttttttcctcaatatccattgataagcttattctttaaaaacagaagtggggaaagtgctagcttttttgcttcttattcacaggaacttgtgcacctgatgtagtatagcacattctcaaacatctaataggtcacttctgaatttttctctgaattttgaataagataaaagtaatttgaatttagctatcatttcaaagaagaaaaaagttgcatttgcaaattatttacacaagcacaaatttttagagaaagaaatactagagaaagaaaaacatagaggaaaataggtggtgaaaaaattctttggaagtgcaaaagaaagaaaacgtttattggcaatgacacatgattattaatccccatgtctaagtaaatttggggtctttacccttgctatagtttggacatgggttattctctccaaaattcatgtcgaaatttaatttcccatgtaaggtgttaggagatcgtgctttgaagaggtgattaggtcattaagacaaattaataaatttctggtgaaactgggttatttttcatgataatggattagttctcataagagccggtcattctaaagaaagttgcctcttttataaagcaatgatttgcctgatttccattttgtttctctgccttgctgtgacatagcatgtggctctcatcagaagctcaacagatgccaatgccatagtcttggactttccagccaccagaaccataagctaaataaacctttttttctttataaattacccagtctcaggtgttgttacagcaacacaacacagaccaagacaacactacacctgtaatacgtaatattttgaaattagattttagcttaggaacaatacatacccaataaagtggagctcagaagacatcacttaagaattgttaaataagtgccatctttttgtttttatactgaaaaacaaatgtatcgattctcaattattttctccctaatgtaacaataataacataatattgtattttccaaaaccattcctcctttctctcaattgtatgtatttttccttttttctttctcctttttctttttggagtatgataaatatttttaaatctatcctcctgaaattgcatctaggatttggatatattttgctataaatctttgcttccttggaataaaaatattctctacatttttattattctaatgttgattcagctttggagttaatttatatgcaaagcaaataatttacccaaacttgtaaaggatatgcattatcagaacacaacacctgcaggatttcacatcacgactatctgttccattacttcctccatgttaatgaattcaagtcttgattttctccaaagaaaatggggcaatgaaaattgcatttcctaaaattctccttgaattatgttttaacatttcaagtgtgttaatgtaatgctttagaagctaaagggaatgattatataggaagctaaagtcatctatgtctatcctcgggattgattaagtttgctatttatacatgtttcccccacaacattgctgtgttggaatttatcaggataggaaccatctaaattgaaaatgccccttcgtatatttttatcacagtgaaagtcaaagcctagaataacagaaaggcacaaaattaatatcatcaggaaacaatttactcagctaattagcataacattctcatataaaaagacagatggattaagggatcaggtcattcatagcctgcagcaaactgcttcagtctttaatcccctgctgttacctatcaaatggtactctttttatggatttggacagatccctgggaagatttagattctcccattggactgattcaccttgttcctttaactttttattgatgatatatttcattatttcctgactaaaacaacagtaagaactctaaattagttagcagctaaagaattgaactaaaggcgtatctccacatttctcatatagtagcttctaccacacacacacacacacacacacacacacacgatgccctgcagtgctaacaaataggctccggcttgaagacaaccatagaagagttatatatatatatatcctacttcaataaaaattgggatttcatgctacatacgcaacattcaagacaattaggaatagcacagtaacagccagtagtaactatgaaaaatatcaaattctttacatggaagtagtcaatcagcatagattatagatttccatgagtcctttaaaaatgtttccaaaaataatgtctaagaaaactattagtgaagatgtttgatctattgtatagaaaccaaaaccaacaaatgaaagaaaaggcctctgggaaaaaaaaattattttaaagttttaggctacagggagataatttatttccctttgactattgtattagctttctagggctgccataacaaagtatcacaatataggtggcttaaaaaaaaaaaacaaacatttgttgtctcacagctctgtaagctagaagcctgaaatcaaggtgttggcaagattggttccttctgaaaagttctgacttaaagtccgttccacatgtgtcttctagtttctggtggttgccagcaatttttggtgttccttgacttgtgcatgcatcaccccactgtctgcctctgtcattacatggccttcttccttatatttctttatgtctctctgtgtccatattttctttctttataaagaaaccagtcattgaattagggcccatcccatttcaatatgaccctgtttcaaaataacatctgcaataacctatttccaaataaggtcacattcacaagtattgggattagtatttcattttggagactcgattcaacacacaatgactataaacaatcagaatgttagtttattaatttataacaagaactatgttatataaaataaaattcttacttcagcataaacagtacatactttccacccaaacgcacatctgtatgggaaaacaaaatgtagtcacatgatagctgggtatgtattagatcagaaaaataaagttcaatgattagaatatttaacaccatcaagctaatataaatgtgcacatgcatttatttttattgtaggaaggcttaccaacttaactggcaatttcacttgcccagacttcctgcctcaggaattggacttccacttaggtggaaaagagatttatgccttaaagattcatctgtagctcagtttccataggcaactaattctcctttcattgacagactctttctataactatgttaataaattcagttccaacatagtaaaatcctctgactttaccccgcttaggttagtttacagtgcttcagaaggcattctttctactcttagttttatatatttataaagggttatataaaactaagagggttgtatttttgtagccatctttctgattatccccatgtactgagaatatgtgtgtgtgtgtgtattgatacattttatttagatgtgtgtgtatatatatatatatatatatgcaagactatatgtatatagtcttgtcctatttggaggcccattaaagtattttttcttcccattcttttacttcaactatgatatacaattaattctgttatacacacacacatacacatacatatacacatacatatatatgtacgtgtgtgtatacatatgttttaataatcaaagttacaatttattttgaacatattatttgccagaatttatatggcatactttgaattcactaacctatttaatctttaatatctaaatgggataattattattatttatttttcaaagatggagtaacaaaggcttctgttacccctcaatgttgcccattctctacagactgtataatagaagttaaaattatttttgcccaacatcaaatatcttgcatcatactgcattcctttcagcaacctgcatttttcagcatcctgcaatttccctataacctggaaattttgaacctccatgtcttcgtgtgtaatattttctgcatgaaaaatgtgtcatttcaacttatctaactcttgcttactatctaaggtaaggtagaagtgccaactttttcaaggttttagataaaaggtgaaaataatagtctcttggtccacactcacatagccctttgtttatattaaacactatattatattatgctatattaatagtcagctgtttattcatctccttcagcagactctaaaggccattagggacttgctaattcatttactaattaattaaagaaatttgaggagaatatcaagaataaccctctacttgttcccggccaccattcatcactcactttcttaattgttcattcacagtgtacatatacggtgatgtcagaaacgttacatcatacttccatgagaaacaactttattaactggagcactgtgcttgtatacacttcctttcacctttaattttacagtctcctctcatttctgaaattacttatttcaacgcattttttcccacccatctcagtgaggttgtttcatatattttcaatacagttataatattttgtcacactctgcattccatcttgcaatccctctacttcctaaaggatagttttttttaaaattatataaattaatgtttcctcctcaagctcaaaaactcttatggattttgagaaatgcataatgttatgtccaccattacaatatcatataaaatagtttcagtacagtaaaaaatttgttttcatgtttcacatatttaaccctacttcctctcctctcacctctggaagcactaatcttttatactatattgttttgccttttttaccatgtcatatatttagcaatatataatacgaggcatttgctgaccaatttctttcacagagcaataaatattgaatattcatgtatttattcctgtagatttatatttatttcttttttctggatgtaccagtatatcaattcacttacttaaggtttaaggccatgtaggttgctgtccatttttgataattataaaaaagaactctgataaacactcacatttttatgtgatataaattgtcacatcattgggataaatacttagaagaatgatagctgaagtacgtggtgagacgatatttagatttgtaagaaactgccaatctgtcttccagcgtgcagtaccatttttaaaattcccttcagcaaacagctactattgctctacattttcaccagaatttgtaatacttcggttcatggatttaagccattttaactaatgtgtggtagtatcacaattgttttaatttgtgtttctctaaagaaaaaaaatactgagcatatttttatatgccagttgccatgggtatttcgggggcaggggtgaggtgtcttttcagattctatgcacatttgtaattggcttgtttgctttcttattattcagttttcagagttatttgtatgtttagataccaatactttattagatatatggtttacagatattttcttctagtttgtggcttgtcttttaactctctggagtctttcacagagcagaaaattccattttaaatttaacaaactctaacatcattttttcttttgtagctagaacttttcgtattaatattatatctaaaaatccattatcaaacctaatgtcactcattacatgtaaagcatgctttctttttcaactattctagtggttccccagagtatccaatacacatttgttactaatctaagatcaccttcaaatagcactccaccagttcacatatagtgcaggtaccttaataagaagttacagcgtgctggcagcccttgctcgctctccgtgtctcctcggcctggacgtccaccctggccgcgcttgaggagcccttcgccccaccgctgcactgtgggagcccgtctgtgggctggccaaggccggagcatgctccctctgcttgcggggaggtgtggagggagaggcacaggcgggaactgaggctgcgcgcggcacacgcgggggcggccctgcactcagagcggtcagactggtgccacaggccctgggcagtgaggggcttagcacccagggccagccgctgcggagtatgcgctgagttccgcatcactgccagcccgcccgctctaggctcgaattcttgccaggcctcagccgcctcgctgtggggcagggcccgggacctgcagcccgccatgcccgagcctttccccgcccgcgccttcccccgtgggctcccagcggccagcgggagtctccccaacggcactgccccctgcttcgtggcgcctggtcccatcaaccacccaagggctgactagtgcaggcacctggcgtgggactggcgggcagctcccccagcggccccagcgcaggatctgctaggcaagccagctgggctccccagtgaggtggggtcttggagaacttttgtgtctagctggaggattgtatatgcgccaatcagcactctgtgtctagctcaaggtttgtaaatgcaccaatcagcaccctgtcaaaacaggccaatcagctctctgcaaaatggaccaatcagcaggatgtgggtggggtcaggtgagggaataaaagcaggctgccacaagggacagtgataaccggcttgggtccgtttccgtggtgtggagggtttgtgtttttgctgtttgcagtaaatcttgctgcacactctttgggtccacactgcctttatgagctgtgacaaccaccgggaaggtctgcagcttcactcctgaggccggtgagaccaggaacccactgagaggaatgaataactccagacgtgctgccttaagagctgtaacactcaccgcgaaggtctgcagcttcactcctgaagccagcaagaccacaaacccaccagaaggaagaaactccgaacacgtctgaacgtcagaacaaattccggacacaccatctttaagaactgtaacactcaccactagggtctgcagcttcattcttgaagtcagtgagaccaagaacccaccaattctggacacgttaatagaatagtcccagttcatccttcatatcttttgtaacataaccatcaggcatttcacttacccacatgctgtaattgcccaaaacatttactaatattactttaaacaaacatgtagtttaaaaagatttacaataagaaaaataaaaaattttttttcctttttcaacatacttgctttcttattgtaaatacaggtttctgatctatatcactcttctcctccatgaataacctcttttaacacatttgcaggaaagttttctggcaatatattccgttagtgttttattgtctggtaaattctgatttcccctctgcttttgaagtataattttgctagatgtagaattctaagttggtgcatttattcctaaacatttcccgcaactctcttctttcttgcctggtttcttactggaagtgggctgaaatccttgctcttttttctctacaaggaatgtagttttcattccagattctgtcaagattttctctttgtctatttattgatttattttattttattttattctacatataggaaatgctatgtctggtgctgtatttttgttgtttgtcatgaattgtattctctgagcttcccggaccggttgtttgtttcatgtcattatgttttaaaatttcttgaccattactcatttagatagattctcctcatttctctctttcttgtctttctgctattccagtttcccattttgtacaactttagaaactgcccagcgggtctttgatgtccttcactttttttttccgtttattttttcttggcactttgttttaaaatgtatttttgacctatctttagtttcaccaattctttccccaaacatgtctggtctactaatgaaaccattgaaagcattttaaaaaaatctattggcgttattttaatttctagccttttattttggttctttgttagaattttcatctctctgcttatactaatcatcttttattgaatattttctacattttccactagtgtccttaacatcttaatcatagttatgtaaatttcttgattgctatttccaaaatatgcatcatcatcactgagtcttgttctgatgatcatcctgtctcttcagattgttaatttttttcttgccttttaccatgttttgtaattttgttgccattgttgagagctagacatgtggtatccataatagatattgagataaattgatgctgagataaattgatactgagataaagttaattgaggatatatgttaatctgtcttggagttgaactgcatttaatatttgttatagctcaagtttctgaaggtttcaaattcctctagtgtccttgtttttgtctcctcccttaactttaggtttccttaagtactcatcttcaaacagtgtctgtttcttatagctcttttgtctgtctccttatattggagtcatgttggtttaaattttatggtatgagcagagaaatatgttctacagtgctctgattgaatatccgcctttcagtgggcctatgtcttaggttatgacttttacgagtgttttgccagtagtttatcttttgtccctattacaggactgccagattcatatgcccactgagcagcaatagaccaatacactgagacatcataatttgcagcagaaaaagagtttaataatcacaatgccattgggcaaagagatgaaggaatcctcaagcttcacatctgtctgcttgaggggttctgggccagggtttttaaggggattgtggcgggtgaggttctggagaattggggttgtcaattgctcaggtcaaggaagattaaatcatcatgatgtgaaaactgcattcttctgtgagtcggctccttgctgggaccttcagatcaactggcatcaacaattttatcagtatgcgtaacataaaggagaaactcaaacagaaagcatatcatctcatgtgccttagatcttatctatagaaaagaaaaggaacacattcttgtgacaagggctacactatcttgggggagtaagaagtaactagctacaaggaagtaggccaaattgggaagtggatttcatgattgccactgattattctgcaagcctagttgaattttattttctcccttaattggtttataaacttttctttgggacagtttcatcctttatcccctttagatgagaaaagaaggttaaatgaggaggtgccaagatggccaattagaagcagctgtggtctgtgactcccatctagaagaacaaaaatggcgagtgaattctgcaccttcatctgaggtatccagattctctcactgggagtgacaaggtgattggcctgacccacagggagcaaggaaaagcagggtggagcaatgcctcacttgggagctgcatggggcaaggggcactcccacccccagtcaagggaggcagtgagtgattgtgctccctttcctgaggaaccatgctttttccatggatctgtgcaactcacagatcaagagatccccttgtgagtccacaccaccagggccttgggtgccaagcacagagctgtgcagactctcatcaccgctcaggctgtggccagtgacagcagactggagactgtctaagatgactgagttcccaggggaaggggtggttgctatcactgtggcatcagttggctgttttcccctggtggtgctggggagacagggaggtttagaccgggagcacagcagctgtggcagatcatggccagactgcttttttaggtggaacctggatccatccctactcattgggtggggcccccttgtgggaatttcaccaactccagccagaggtttatggacagaactctgatcttcctgggcagaactcctgtggggagggacagccacagtctctgcggttcagcagacttagtctttcctgcctgctggctctgaagggtctggacattctggacaagggagattccctccagtgcagtgcaccctctctgccaaggggcagccagagtgctttgttaagtggtccccgatcctgtacatactccctaactgattgagaccaccaacaggggtctccaggcaccttatacaggagtgttcctgctggcatcacatcagtgcccctctgggatggagctcaaaaaagaaggagcaggcagccatccttgctgttctgcagcttccactggtgacacctccaggtaggggagggaccaagtgaatagggtctggagtggacccccagcaaactgcggcagccctaaggaagaggggtctgactgttgaaagaaaaacaaacaaacagaaaacaacaacaacaaaaacatccacaaaaatggccccacaaaaaccccttccaaagatcagcagcctcaaagatcgaagatagataagctcatgaagatgagaaagaatcaatgcaaaaatgctgaaaactcaaaaagccagaatgcctcttctcctccaaatgattgcaacacctctccagcaagggcacagaactgggtggaggcttgaggtggatgaactgacagaagtattcttcagaaggtgggtaataacaaattttgctgagctaaagtatattctaaaacaattcaaagacgctaataaccatgaaaacattataggaactgtaaaccagaataaccagtttatagaggaacataaatgacctgatggacctgaaaaacacaacaccagaacttcacaatgcaaccacaagcataaataactgaatagaccaagcagaggaaagaatctcagagctcaaagactatcttgctggaataagacaggcagataagattagagaaaaaactgaaaaggaatgaaaaataatcagagaactatggaattatgtaaaaagaccaaacctacaactgattggggtacctgaaagaaatgaggagaatgaaaccaagttggaaaacatacttcaggaaatcattcaggagaatttccccaacccagcaagacaggccaacattcaaattcaggaaattcagaggacttcagtaagatccatgagaagatcaacccaaaacacataattgtcagtatctccaaggtcaaaatgaaggaaaattgttaagagccacgtcacctagaaaaggaagtccatcagaataacagtggactcctcagcagaaaccccataagccagaagaaattgggggctaatattcaacagtcttttttttttatactttaagttttagggtacatgtgcacattgttcaggttagttacatatgtatacatgtgccatgctggtgcgctgcacccactaactcatcatctagcattaggtatatctcccaatgctatccctcccccctccccccaccccacaacagtccccagagtgtgatattgcccttcctgtgtccatgtgatctcattgttcaattcccacctatgagtgagaatatgcagtgtttggttgtttgttcttgcgatagtttactgagaatgatgatttccaatttcatccatgtccctacaaaggacatgaactcatcattttttatggctgcatagtattccatgatgtatatgtgccacattttctgaatccagtctatcattgttggacatttgagttggttccaagtctttgctattgtgaataatgccgcaataaacatacgtgtgcatgtgtctttatagcagcatgatttatagtcctttgggtatatacccagtaatggaatggctgggtcaaatggtatttccacttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctccgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgctttaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactttcaataaattaggtattgatgagatgtatttcaaaataataagagctatctatgacaaacccacagccaatatcatactgaatgggcaaaaactggaagcattccctttgaaaactggcacaagacagggatgccctctctcaccactcctattcaacatagttttggaagttctggccagggcaattaggcaggagaaggaaataaagggtattcaattaggaaaagaggaagtcaaattgtctctgtttgcagacgacatgattgtatatctagaaaaccccattgtctcagcccaaaatctccttaagctgatgagcaacttcagcaaagtctcaggatacaaaatcaatgtacaaaaatcacaagcattcttatacaccaaaaagagacaaacagagagccaaatcatgagtgaactcccattcacaactgcttcaaagagaataaaatacctaggaatccaacttacaagggatgtgaaggacctcttcaaggagaactacaaactactgctcaaagaaataaaagaggatacaaacaaatggaagaacattccatgctgatgggtaggaagaatcagtctcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactagaaggctacagtaaccaaaacagcatggtactggtaccaaaacagatatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagagttaaacgttagacctaaaaccataaaaaccctagaagaaaacctaggcattaccattcaggacataggcatgggcaaggacttcatgtcaacagtcttaaagaaaagaatttccagctcagaatttcatatctggccaaactaagcttcatgagcaaagaagaaataaaatccttctcagacaagcaaatactgagggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcagagtatttcttggtgcttttaagctgttaatagaatttgaagttttattgattgacttaggattatttgtaagaacagaagttgttaaaaataaggacatgtaggaagagcagagacgttctacctctaagtacagttgtcccttggcatccatggcgtattagttccagaacctctgaggataccaaaatctattaatgttcaagtcccttacataaaatggtgtagtatttgcctataacctatgcacatcctcccatatactttaaatcatctgtagattacttataatacctaatgcaatgtaagtgctgtgtaagtagttattatactgcattgataaggtaatcatgacaagaaactctaaactctactatggaaagctacacagagtcaacctgtttctcacaatgggtttctgttaccttcttaccaagctctaattcttgataaagtctgcttattttccccaaataacttttagataaaatctttattttcagtttgcataaaagttagtgcttattctgtgaatctgacccataccattattttctttttgatctgggtctctggcattggggcgatttgtaaaactatattaaagtatttgggggtaatttactaaacaggtcatagttgtccaaaagaaatattgaagtatcctgagagttcaaatgtgatcagtggttattgtacttaaaacaattacgtagtaacatcatccccatgttttcaaagtagtattgaattaggctattttggtccttatagtaagcatgggttttcatacctttctgataaatctgactgatgataggacttggactaatatgttggcgttaaatattatttgaatctggtaagaaagaaaaatatattgtatgcttttattagaaatagcaaatatcagtttatttcatcatagccagttttgccattttatagacaaaaacttgacacttttgagagtttaattaaacacgattcagcttttcagaggaagaaagaaaaactaaagatcacagagaaagcttttatacaaattgtagttataaaaaatgttaatgtttcttgcttctaactttctttacaataaagattttattgtttgggtaaagatggaacattcattgtaaaaaaatttaaatacctaaaaaatacaaagaagaaagttgaaaagtaatcatctcactattgtgatatacaagtaagggctgggcatggtggctcatgcctgtaatcccagcactttgggaggctgaggcaggtggatcccttgaggccaggagttcaagaccagcctagccaacatggtgaaatccagtctctactgaaaattcaaaaactagccaggcgttgtggcgcaccccataatcccagctactcaggaggctaaggcatgagaatcgcttgaaagctgggaggcggaggttgcggtgagccgagatcacgccactgcactccagcccaggcaacagagcaagactgtatacacacacacacgcacgcacacacacacacacacacattcatacacacacacacaagtaggtaaattttattccagggatctctctatgccagtgctacttggtagtatgttgaatggcagcctcagcctcagctgggagcttgttagaaatgcaaattcttgaccaacccagatctactgaatcggaatctctaagggagggggtcaagcaagctgtttttaataagcccttcaggtgattcttatactgtacagccatactgcagggatattgtgggcttagttccatatcactgcagtaaactgaatatcacaatagagtgagtcacacacatttttttgtttcccattgcatataaaagttatgcgttttggccgggtgtgatgtgacaggcctgtagtcccagctacttgggaggatcacttgagctcaggagtttgaggctgcagtgagtcatgattgcaccactgcactccagcctggatgacagcatgagaccccatttcttaaaaaaaaaaaaaaaaaaaaaaaaaagctgtgtttatactatactgtagtctataaaatgtgtaatagaattgtctaaaaaacatacataccttaattaaaaatatttatggctaaaaaatgctaacaatcatctcagctttcagcaagtcataatctttttgctggtagagggtcttgtcacaatgttgatgggtgctgaccaatcagggtagtagttactgaaggttggggtggctatggcaatttcataagataataatgaagtttgctgcattagttgactctccctttcataaaagatgtctctatagcacatgatgctatttgatagcattttacccacagtatgacttctttcaaaattggagtcagtcctctcaaaccctgctttatcaattaagcttctgtcatattttaaatcctttgttgtcattttgacagtgttcatagcatcttcaccaggagtagattccatctcaagaaaccacgttcttttcccgtccataagaaacaacttctcattagttaaagttttcttatgagattgcaggaattgagtcacatcttcagactccccttctaattctagttctcttactgtttccaccatatctgcagttatttcctccattgaagtctgaaatccctcaaagtcatctgtgagggctggaatcatctttcaaactcctattcatgttgatactttgatctcccatgaatcacgaatgttcttaatggcatctagaatgatgaatttactttgcctagatccatcagaggaatcactatctatggtagctatagccttatgaaatatatttcttaaataagacttaaaagtcaaagttactccttgatcagtgggctgcagaatggatgttgtgttagcaggcatgaaaacaacattaatctccttgtacatctccatcacagctcttgggtgatcaggtgcgttgtcaatgagcaataatattttgaaggaatctttttttttctaagcagtagatctcaatggtgggcttaaaataaaccatgctgtaaacagatgtgctgtcatctaggctttattatttatagaaaacaggcagaggagatttagcataattcttaatggccctagaattttcaggatggtaaatgattattggcttcaacttgaagtcaccagctgctttagcctctaacaagagagtcagcctgtcctttgaatctttgaagccaggcattgacttctctatagctatgaaagtcctaaatggcatcttcttccaaaaggaggccatttcatctccattaaaaatctgttgctggccgggctcggtggctcatgcctgtaatctcagcactttgggaggccgagatgggcagatcacgagttcaggagttcaagaccagcctggccaacatagtgaaaccccatctcgactaaaaataccaaaaattagcctggcttggtggtgggagcctgtaatcccagttacttgggaggctgaggcaggagaatggcttgaacccgggaggcggaggtggcagtgagctgagattgcacattgcactccagcctgggtgacagagcgagactccatctcaaaataaataaataaataaataaaaaataagtctgttacttagtgtagctactttcacgaatgatgttagctacatcttctaggtagtttactacagcttctatatcagcatttgctgcttccccttgcacttttatgttatggagatggcttctttctttaaatcttgtgaaccaacctctgctaccttccaacttttcttctctagcttcctcacctctctcagccttcacagaactgaagagagttagggttgctctgaattaggctttggcttaagggaacattgtggcttgtttgatcatctatccagaccacttcatatcagcaataaggctgttttattatcatttgtgtgtttactggagtagcacttttaatttccttcaagaacttttcctttgcattcacaacttagctaactggctcaagagacctagcttttggcgtatcttggctttcaacataacttcctcactaagcataatcatttctagctcttgatttaaagtgagaaacaggtgactgttcctttcacttgaacacttagaggccattgtaggatattaattggcctagtttcgtgttgatcatattctttatgttgtcatggttctgtcataattcttttagttctatgttttaatagttttggtgctcattaccagtactgttgcttctccattcccgagttagtccatctcctgattgaatttcattgtcaggcagtcttttcaagttacaggtactgcatgcattctttgggttcttatacacttcattgattcaaaatatttgtcttttgtttttatattacttgaaggattacttggctaggtataaaatttatcagtcacacttttttcccccaaactttgtaaatgttgttccataatctcctagtgtttgattggctggatttctttgtccaatgttttctccttttattaggaagaatttgtgagtattatagtctctgagtttcaatgcttgctgttttctttaatgcttgagaatgtctgtctattgctttcgttcctgaaaaataacttgtttgggaacactttcattagaactttgtggtcactgttttattattttgggacatctagtgttactgtagaaaagtctgatttttctccctccctccttgaaggcacttttttttttttaatctaaaatgcctgagagttttcttctttatttttgaaattcagtaatataaacaaggtatatctaagtgtcacttataatcatttttccctaaattataatatgcccttagttcttctaagaacattttccttgtttattaccatgaatactttttttttggtcaaattattagatcctctacttcatgacaccagtttttttaatactgaattttcttttgttcttcgtatgtattctaattgctttgatgtgtcttttacctttgcatttactgtgatcatctgaagcctttctttttgtcagtaattctgttttctccagtgtctgtcctgtttttgatattttaaatgaattaattggttaagtcattaattattaattaattggttaagtcaataattaaattattaataattattaattaattggttaagtcaataattaaaaataattaattggttaagtcatataggctctaagtttctttagcactacaaactgcattttcatcttattctgcttcttcttgcttttgagcttgtttattataaggttgtattgttttcaagttcttcattatgatgaagttgttgagaattttctttagtttttattgggttatgtatccttccagaatgggttggttctttgccatttgtatgccctattcatttcttcattttgtgttctttcttgctttttattccctgtatgtgtgtgtttctttttgtcaggctgtaatacatatgcatacatgtttcttcttgatatgggagaacttctatgtggtgctgatgggaaatatttttaatactccactctccttacccaagtttgtttttctcctgagccctagtttgaaagctgtatattgttggagtggagggaaagagaagggaaaagtggtgattcagagagccaaatggggcaatgtggcttttaggctctgctctcttgaagtaccaagtatttcactcttgggtctgcccaagtgcttatgaataaaattcctttgccttgtatggggacatcattcgacctcagacctctcatttctctttgttctgagccctagaatgtgacctgaccttctccttcccaaagcatggagatggttaaaactcactcttgaaatttttttgttgacttttccctgtgttgcttattcattcctcggctctactttttgccattttggagtgtatttctggtaagtgtttaggattttgtaaactatttccctacaacctcttattggaggtaggggtagagttgggaatgaccatcaatcacatataactttgtttcttattttgactatcagtcttcaaaatttatggcaggcccttttatatttggttgctgctaataaaatgttggcctttttgttttattttttatttttattttttgttttattagattttgaagaagggagattctaaaatgtagttcaggttttctcagtgtcagcacaaataacattttgggttggataattatttgttgtgagggggttgccctgtgcagagtaggatatttaacaacatccctggcttctacccactagttgccagtagcattcccctagttaagacaaccaaaaacatcttcagacattgccaaatattccctggggagaaaagcaccctggtttgagagccactgatcaattttgtccattcatctttactcctcctaaatacctacatccaaattttaaatagatctttctcatgtagtctggcaagtattatatcaaagataaataccagttttagaataaagcattaatatactcttacatttcaacttaagaggcaaatattaacagtaggatttgtaaactatttattagactaaaaatcaatgaatttttaaaaattacaaaatgatttatgtatgttagatattttactgagtgaaaaaattcatgcttttttaaatgacttattgtttggagtagtgatacagtagatttaattttccccctcattaattaaaattatgttttagccaagaaagtgaacaaaattcttattggcaattcagttgtttcccgttttggagactgacactctccagttctaagttaaataattgtcatggtaaagtaatttccttgaaaagaacggacattgattcagcccctgttactcacaaatgctatttgagtcaaattggaaaactattaagtttttgggaaaaaaatcaataggtatcaggaaaccattagatcttgtggcccttgctatatcttgcatgagtaatcactgtaaacagctgacaggtatttcattgttgacacagagtgatgcttgggggaccacatcttttcagagcaggtggacagctttagacgttggaatgagtttgattatccttgtttttctcctacactcattcttttagacagccctgtcactaactgggcctgtgatgctttcaaaaatcaaatactttccttgctgtcagttttctttttcttgcgttgtggcatactaatcagggtatgtggtttggtactgaaccaatttctgtcaaaagcaagttttaatttattatttaggaaaaatttttcctaagacccaggttttatacagtcctaaataaatagtgtgaggaataattagtaatgccatagagtatataattttacttctagttctacacagattacaagtaaattttttttgggcaagtgattttggaattatctatgttttgttttccttttcctttagagtgataattcactatttatgattgaatgattatcatattaaagaggtgagaaaataaaaataagtctgatgtgcacaaagccatactgctcaaattgtttgataatatctgttaattaaattattatggcatcggtagaagaatgatgttttgtttatatgtggttagaattggtcttttttaaaggaaataacaagagagatggaaatggaatgggtataaatagtaaaaggttctatcactataattcccttttgctctaaatagttaaagcttctatcactataatttccataagaagatatatgtgtttacctgttaattttatcagggcaaattaaaacatggatagaatcatgtttctcagtgtgaagaaatatttttatttgatgaatattatatattttcaggtgcagtgacttctatgttttgggttgatgctgaattagggagtgatatttaccttgatggtaagttaaaaaacagttttcttttatctttcttgttttttttttgtttttgtttttttttttctgagacagagtctcactttgttgcccagactggagtgcatggagtgcagtggcatgatctcggctcactgcaacctttacctcctgggttcaagtgattctcctgcctcagcctcccgagtagctgggactacaggcgtgcaccatcgtacctggttaatttttggatttttagtagagacggggtttcgccatgttggcctgactggtcttgaacccctgacttcaggtgatccgccagcctcggcctcccaaagtgctgggattacaggctgagccaccacaccctgcctcttttgttttttagtaaaatctttatggttaagcttattgttgttcattcatgttataactttaattccttgcattgtggttcttttcacactttagtttaatgatgaaatctttgttcatatagattaaaaaaccccagacagtggtggaactcgatgtcactcaacttccaatttagtgcttccactaaggttttctttaaaaaaaacaatgctttgtaggttttctgtatcctctgttgtttgatttatgtccttaatgtaatgttagagccttttatttttatcctccaggcaatatgaggatcatatttttgcttttattttctcttgaagataagaattaaacactcctcccttactttatttacctgaacacttttgggcaatgatatgccttcatttaaaatatattagaaactttcttagttaagcgactatgttttctccctttctctttccctttttcacctttttaaaaaccagtcgaaattttcttactttttcaaaagtaataatcattaagaaatttaagaattattaagctgggccccatcattgagctctaatatatgtggcgggtaactggttgaattccttaggcataattaaactcattcttttgttatcagcatatattcagagactgcaaaatgaattggtagtttggaaacttaggcatatgttatgtaaaacatttatgagttggatttggatttggtgagagatgttaggaatgataccttaagatgtctcattctttaggcaataatttaaatcttaagaaaagtcttttttttgattatgtgaaaataaactagaaataacctgtcttatgtacttatcacatttgactatgttatgaaatttgacttatattttggattgtaagctttttcagtgccaaggaaatcttattttcttatttatttaatttaaaatttttatttgttttatatcttctctagtgccttaaaatagtgctagccactcaggaaatgcattgacttattactggaatttaattaaatggcagcactggcaagagaaaaaaacagtacattgttttattgagtagtatttgtgaactgaaataggttagttttaattttcattctgaagtatggttgcacaagtattaataagcattctttttaaaaagtgattaaaatgttttttcctttgtaggtatcataactattgtggattcaaaatatggattaaaagtaagttgaaagattgctatgagtggctcattattgagagctgggaatatggggattgattgtttaattttctttatgtttgtatctgaaattttctttaacaaaaacctttctcaaaaagatatcctgaacaataggtgaaatttgtgttttaattattagtttgtgttaaatatttcttttctattactctgagtttgatttggtgataaaatttggaattataatttgtaataagcatatggggttaggatagagtttggtatgtatagctcttcacaaggattcaaccccaatattggtaagtttttctgttccatagaagaagctgagcttgataaagcatctgagatcttatttttcttgttaaattactattaaacacacactggaaatgagtttttaaaaaatattgaagacctaggtgatgggttaataggtgcaggaaaccaccatggcacgcgtttacctatgtaacaaacctgcacatcgtgagcatgtaccctggaacttaaaatttaaaaagtacatattgaagaaaatcaggatatacacataggattagtaagaagactctctccattaaaaggcatcttgcatcgcttcttggtcttttggctaagatcaagtgtaaaagacatcctgctatgaatgtttttgttaacttctaaggtcctagaatgcatttaaatgaggtttaatttataaaatgcatttagtaagatctttaaaagtatgttgttacatacagtaaaatgacgtttctcaacttcccaggtgaaataccactaaaggcagaagagaatgaaatcatcccacccactgacccgttcccaatctgagcatatggatagggcccaaagcagtaagttcttagaagtttaaattcagtgtttaaaaattagtgactgttttgtatccaacctcatatctgaacatgttaatttttttttttttttttttttttgagacagagtctcactctgttgcccaggctggagtgcagtggcaccatcttggctcactgcaacctccacctcccaggttcaagcgattcccttgtctcagcctcctgagtatctgggattacaggtgcacaccaccatgcccagctaattttgtatttttagtagagacaggattttaccatgttgaccagcctggtcatgaactcctgacctcaagtgatccacttgcctcagcctcccaaagtgctgggattacaggcatgagccaccacgcccggcctgaacttgttaatgtttaagtttgcttttttttttcccaaatctttgctgaaattatgctctaaggggatatgtcaggtttgtcaaatagctaccaatacctcttcactgggccttctctccctcgttgatagagtgccctaatttgaaaagtttggaagaaaactccttttttagagtttaaaatctcaatttatgaatttatgaatataatttaagaatcaaagaatgatcccaaatacagtattacagtttcacgcagaaaaattccaatgactgttggaaatcatatttcttgaaaaatgcttatggaggtagcaaaaaagccccaaattattcattttgaatgtttattataggcatgtttgaatctacctcttccataaatttattacaaaatttgatatacctatgtgacagataactgctaagacattttgttttttttttattttgatagactgaaaatgccatgctaaaagtcaaactgtttatgtattttatgattataggaaaaattttatatgtatagttgggtatggagaagagttaaatagaatctattatcagcatgatggaggccaaaaaaacaaagcaacattctgaataatgcaaacacagtaaacgtttaaccttctgctaccttgataaaacctcttaaattattaaatcaatatacctacacgaaactgacacactgtcaggataatggaaactttaaattttctaagtcggatgccagataaataactttgccttgatataaagaattttccaacttgtccaattcctctggttgcaaagcttgacctcagtagctgcttgtgattcagagaattctgaggcagtacaagtaatgacacttggataatgggcagcaatttaagaatgtcatgcttcacagagccagcccatgacaagtaaagctgagaaatggtaccctgtggccagccagccaaattgaaactgaagtggtaattgatatcatggggtatcactctaatgggattgtcacccattgatctgaaatattcattttttaatcataggcaaagaattggacaacttaaaatgacagctctctattctgaggacttgacacccgggctactgacattgttcttttcagttctacaaatgtgacagcatttaatgcaatagaagcaatgaatgaagttacccagagaaggtcaagtgagaggtttcttcttggttcctctgttatattgcacaatctgttgaaacaattcagtcagaaaacagttagcttggaaaaggccagaacaataaatagactgacattatgcaataattttttaaaaactaaaatagtgttacatctgtaaccaatccatttgaaagaaatagttcctgctgctgctttttaaaaatgacaccagacatctttgacactagatttatttccactctggtcaacagcagtgttctttcatagccagtgggttttaagacagttttttcttttctttctttctcttttttcggtccggcttctttctttatttctgcagaaaaggacaccctatagcccttcatgaagttaggtctacagtggtgttatttcagagagttcctttgtttctctccctaaccccccagctttattgaggtataattgacaagtaaaaactatatatatttaaggtatacagtgtgtgaattacattatcaaacaatcgagctagttaacctatccatcacctcacattgctatttttttgagagggggtggtaagaacaattaagatctatgttttagcagattcaagtatacaatagaattaactacagtcatcatgctgtaattagctctccatgacttatgcatcttgtataacaaactttgtattctttgaccaacatctcacaccactcccctttaatttcctttgtttcttgtgataagttaaattggggttttgatccttagccttttgaatatgttggattaattagtatcaaaattatttttgtcttttttgatatataagcaaaagccatagttgttaagcagagataaggaatactttggacatctatgtaatataaaatatttaaaaaatattttgcaaaatttttttcttcatttacttatacaggtggaatagaatgccaaactttccattttgttttattttataaatgaaagtcatctgacttaacgaccaaatggtatataatgtattattggagaatgttcttttgaatagaagacattgattttatactttttgcagagtttgacttgggaaggtaggaagtcacatgagggaaatgcagggctgatgtctaaagaaaataaatgttaatatgcacttatttttttaaatgtttgtatagctttcctatgggcatagaagaggacatttatctcttctgctataattgtatatgattacatataattttaatacagctgtaaatattggcaggctctcatttggggtgattttcatttatttttatatttgatactttctgactgcctggaagtagtaaaacgttagtctaccactgttagctttgagtgaagaattctaatattttggagaggtaaatgcatttaaaacattgcacattaccttgtgaaactaacattgtattagttacatttaggcatggaaatgcaaaaacaaatctgtaattcttctgtcatatcatttttatgcctcacaaactcatagccaaataaccccaatttcatatgttaaaaaagctttcataaggtcaataatataatatcttgaaaaatatttcagtttaaaaagaattttcagtactataggatcattcagaggcagatgccttgccaaaaatatatcattgttaagtagatttactgcttaatgggaagagatttgttgctgcatgttagatggcatttttcatgtaacatcttttatgtatccccacaacaggaggtgttaattacaattcattcaacaaatatttcttgagcctttgtgccaggcaccattccaaggtctgttagcagcctcattctctagaggcagagtatataacaataggacttgttgtagcctcaggccaagatgaattatgaaaaaaatattaaacttgatcttttggcatggaatgatttttgatacaatacttgtcaagttctgtgacttccataattgcagagtgggtctgcagttgaattgaacaagattttgcctgaagtagaagtatcattgccatgattttatttcagttttgttttcctcaaaatagaatttgctgaacttttagaaggaaaaaatgtttcttctatagaactaatcaagcgtgttaaataaaattattacctgcttgctctgaggttccaaactattcagatacccctaatgatcatctccccatgaattatgaaactggtttggctctgatatatggttattgacatttgtgtagcattgtacacagactgattttatgtggcataaaagatttcacaaaggctttaaaattatgttcattttacttgatgggtgtgtgttcaattaaaaaaaaagtccctgtgattgtatataaaatatagtatcctgtgatgatgagggtgttagatttagtttcttcctttataaatgaaaatagccatctcccataattattatgaaagctaaatgagaaaaatgtatataatttataaagttagattcaaggatttaattcatttgtaaagttggcttcaaatatagagtattactataatctagttgcctctaaacctcagtagccagctttttattgtgacagggaacctctattgaggtttgaggtaatgagggtaaaagtgtaatttcccagagaagaagcttgtgatgttgatgacgttagggatgtaaacaggattatgagggggaaaaaaaaaaacagacaacaaaacttgcctccagagagatggaaactaccacttgggctctaagtcagtgtcaaaatattttttggagttagcctgactctggagaggtcagtaaaataaacagttgcactgagaggccagattagcaagtatgggtttctaaatgataaactgcttttaggctagaatcagggctgaatcagccttcccaccacttatttgtttctagggtgtttgaaaggcctagtactgagttcacgtggtgcatgattgtgggctggggtgcagggaagtattttagattctaatatgggggtttggtgtgaagggaagtatattagattctaagaaactatatttcagtggttatcctttttttaaaataagtaataatgaatatttagaaccagaacagttttgtaagaaggaaaatacctaaaatctgaactgtaatcttctatgtttttatgacattatgtgaatcaaaggggttttccttttaagtaaaagaaaaggtcaggagtatgaaatcctaagccctcttcctccccctataaaaccccacaggttcacttgtagaaaaaaattgcaaatgaggaagaaaaatgctttcagctagaaaagttagttttggatttgtgtattcagtaacagaacatgttgaagtttttattaaatgcaagaaaatgtctctaaagtaaaatcctttgtgttgacattagattttttattgtattatagtaactttattcaaacttttttttgtttagcatttaacagaagagaaacctgatggccttatcaatgaagctactaggtattcatatttaaagtatatattgattgctggctaattgtaaagagaaaaatcactaagatgaaaaccaaaaacaaactaagaaattttaaaacatagtcaaggaaaatttgttttctttttttcccttagttgaattattgctatctatttataatgatctcataactaaacttttacttgaagtcatttttgtcgtagcataaagtgaatgctgaacacaggagttctgtaattttgaggaactcgggaaatattaacatttagaaatattttcttgttatacaatttctttgggattgaagattttttatatatatatatatgtgtaataataattattattattattttttgagacagaatctcactctgtcacccaggctgaagtgcaggctcactgcaacctctgcctcccaggttcaagcgattctcctgcctcagcctcccaagtagctgggattacaggcacccgccaccatgcccagctaatttttgcatttttttattttatttattttattttattttatttttttttagtagagatggggtttcaccatgttggccaggctggtctcgagctcctgacctcaggtgatccacccgcctcggcctcccaaagtgctgggattacaggcatgaatccactgcgcctggctgaacttaagtatttttgtaacttttttccttatgaaaatatggttattatagaaaatataaataagccaaatagaaaatagccaaattggatttgtgatgtacatactgttgaaacctgctctttcagtgaactaaagttaatttagttttgagaatttagttgtattctttgagataaagcataagaccctgaataattgaggaaaattgaaagaatttccagttttactatcctgttaatagaaaatagagcttctgattattatcatctactttgttatctagcattcagtcaactggattctttacagagataatatacagtatatttatagtgataaagaagacatttgtgcaatatcctgatatatcttctgaagtatagcttattttttttaagaaatggagtcttgctatgttgcccaggttggacttgaactcctgggcttaagggatcctccctcctcagcctcctaagtagccaggactacaggtgtgctctaccatgcccagctctgaagtatagttttaaaaaacctgtttaatacagtttttagtattaagtgaagttattctatttctttgaaaattttggtaaatattacagtattttagtaggtaaactcttcttctttttaccatattggatatctgaattttatgcttttcttcacaaagaaaattatgagtttaaaatcatccttttgattgtaaactttttgagacttatctttgtagcgcaagagtagcaagtaacagaacttagtaaatactttgcaaatgggtaatgtgaaatctgaacttgcatagtaatgaatacaattcattcacattgaaaagttagcggattaggagtaaactgaatcactcctatagagcactatataattcttaactgatatattgatctacatgaggtgtttttatttatttttaatttgttaacatttctcttttgatgtattaatctgcatgcgtgtatattatttaaaatttcttaacatttctttttgtttgctattttaggcaagttgctttggcagatatcattctcattaataaaacagacttggttccagaagaagatgtaaagaaattaagaacgacaattaggtacaaaatgataagtgtgttaagtgcctacagatccatattgtatacacagaatattttttactctgattgttgccctgtagaaacttaaggtataaggttgacctgcttcaagaacgttagggaatcacatatattgttgatggctaattgttatataaatggtaatacataaaattagtcctcagtgcttgcagaatatagttcacagttaatagactgatattcagggtcttcgcactccatctttcttttcctgtcttctctttgactctttcctaatgtcagtcttccctaactttacccaggatggttaattcactttcccatggatgcatcctctcagttcctgtctttactcataatgtattctcactctgccaatccctgagttctttcttgttctgtttttttttttttaaatttattctatagagcctattctgtctctccccgcttcctatgtgaagtcttccctgactcaagtggtctcagttttccctgaactcttgttgacttcatcttccttaactgtcaaccatgccttgtcttccagcttgcttgtatatcttctttgtccatagccaaggctgatcagcataggacaatcaggacaatatgaatgatgctcaaatatgtgctaacagtcattttgctgactgttctggagactcccattccttttgaaaacaaagatggacttttcaaatgaagttatagttcagggactttgttttgaattattttgtaagacctgaactaataaaagccctatacagagagacattcggtagctattattattggttatctttaatgtgtacaatgctttgagcgtgatggtggctcaaaattactattcttagtatttataagttctactgacattagattttgaatctgtcatctcagttcatatagtatatattataaattgaatcaataaaggtaaggctcattaggagattatttgccatgattaatgattgtggaagaaagaaattcacattttttccacatatttcatcttattttaatagtaatgtccttaaactttactataaaaaaatataatgtctccatgtggagggtaggtattgttgcctagtgttgaagatcacagaccttggaatctgcttgggttctaatccttggtctgtttctcattgtcttcttagggagcttatttacccttttaaagcctcctctgtaaaaggcataatgcctatcataagtttgctttgagtattacatgagacaatgttggtaaactttgcacagtgctgacacatagtaagtgctctgttagctattattatgtaatttttttcttagcttacatagtaagttcaaggtatagtaaaaaagggaagaaagaaaaagatggctgattttgaaaaggagaaagtgatgaatgaagattgcttttacattttttgacactggtcttctaatcttgtttccttcataaatcttgtgcaccattgtgattgctaagaagaacacaatctatttagcaaacgtttttggcataaaaggaatgataattattacttgacttttatatccttatagagacctaagctaaatctctgacactgacaatattgactattagccagcttgttaacagtactagaaatgaatttggaagaagcaatttgataaattacacacccttttggcttttaccctccctttatatcagacttgtgactgactcagaatgatatttggggaggtgaaaaaaggtaaacatgtttgagaggaattagccatcagactagagtgtattcaaaaaagaagatttaagaattttgtaaaatagtggagagacttgcctcagaatcattatatgtgggaagccttacccatgagaacaaccttgaacaagtagcaagaatcttgggtaagtaaccctaaagacaattgaattcatgatagagaattgatgattgatgataggcaatggaaaagataaatagatgaggtgtacagtgtgctgaaaagaatttaacaggtactttttggtgccatacaaagccatattctatagtatcaaaagagggagaataggcataacgggtagagagcctaattagggaactgacgaggttattctataaaggaacctgggatgtgtgacttagaattactgtgaatactaaggacagactgggggcaaagcaacttacaactaggtttttatttttagtgtgtatatagccatttctaccatgtatgcctgaggaaaaaagtgaccaccgtaaaaattttgagtatctactcatttttaagatcactaggataactgactatttatgaatgattttttctaaagtgaagcgtctttttattaaccacaaagtagcccttaatctgacagttgtgcgaatttttgcatatatgttttattgatgtatgagtggaatatatgtgatttattgtttgaaggaaaatcataattattttttaaagcaagttttgtttttctgtttttaatttttttctggttccagatgtatttgggtatgcttatttcctgttttagaaacaatatactttgtatacttttttaaaaagttaatttttacttttaaactttgtcttcctcatttattatttatttcagatccataaatggactaggacaaatcttagaaacacaaagatcaaggtactttaaaaaagctattcctattaataacaaatcattttagttattaataataaacattaagtaattgacaaatatgcttgattctgatataagaaagatctaagttcatttaaaaagaattggatccaaaatgttgtttggaatgctcttaataagttagtttggcatatttggctagtacatttgcctgtcttcaaaactaagattacaaagccatggtaacactgtgtaagtgtttgcttaatgaggaagaaaagacttccaaacactcgagagggtaactcagtacagaaatctgaagtatattgaggaatcttaatttgaagtgtttaaatggcattttaatatttaaaaagccttcttagtgttttatagttgccaaaaaatacatggagtctttaccttgaagttcctgacaaattcttttattaaattttgactttcattttctctaggttctgttcctaaaacatctgtgaagtgtatttctgtagattaaattctgttttccattgaatgttatcttaatttcagaaaatttctgtgcagggatattttattaagctcatttttttttttttttttttttttttttttgtggtgagaaaggctcagcagctgatagactcagcaacaggcagccaggagctctgaggctcacagctggcagtctagttctactcagtctctacttgagaaattctttctttggaagtacagcagaggccttagatgagtggcttgtctgctatggcagagattagaggtgctgccagactgccattaagtgttaggcagtaacagcagcagctgcttatatgcatgtgaacagctggggaattaatttggtatgcattctcaggagccgctcatctgctggcagaggtagccgaagaatgccctttagtgtaagtcctctacaaccatacaccaaatgtgctccctgcatttcaaattccattgtagaaagtctctgataatctcacttataccatgagccattcctcagtatctgtcctcttcctgttagtgttctacaattcctttctccttaatttttctccgctttacaaaatgtcacacagacaagtgcataatacttaaacaagcttttaaaaataatgctcataaatagctttggttctgtcataatattcgtatttataaacattttaagtcaattctcttcttttgttttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattcttcagtgtatggttcttgccaatgcatctgagaatctagggactttctgaaatagtacttccttgctatgaggactgaagttggattagaatccgtttcaatgaagatcagatgtcctgagtagaattcttactattgggtcctgaatcttacattaaatattctctcaaattccttgaggcatagcaacttgagcttaccagtttagaaactggagatttgggctgggtgcggtggctcatgcctgtaatcccagcactttgggaggccaaggtgggcggatcacgaggtcaggagatggagaccatcctggctaacactgtgaaacccatctctactaaaaatacaaaaaattagctgagcctggtggtgggcgcctgtagtcccagctactcaggaggctgaggcaggagaatggcgtgaacccgggaggcggagcttgcagtgagctgagatcgcaccactgcactccagcctgggtgacagagcgagactctgtctcaaaaaaaaaaaaaaaacaaacaaaaaaaccggagatttggttaacaaaatagtcaaagtcactcttatagaagttttgttttattttttgtttttttaaatttttttaccattttgtagctgacaagtactgacaataaactgctataagcatgtgtagaaaaaggctcaccttgagtagttaagattaaggaaaaggaatagtgtgtagcatcgtcttagtggtaagacttaagttgatttagtagcaaatggaagtactagtgaaccacatagatttcagaagtaggagtaaaaggttagaagatgtgtcattttaatcttctctagactttttcttaatttttagaaatgtaagtggactgaacagaggaaaaccaaaacacagctggtcaataataagttaaattaatttgacaaactgcctgctatgcatttcatagcattttaaggactatataagcaatggataaggcgaaaactctgcctttaaggagatcagtcattggggggaaacagaagcaaacaaacaaaaaggcaacataatagatattaatattaatacaagaattttaaaagcacagagttctataataataggaaaatagagggaatgattgctcaacttttcttgaaaaagagtcaggaaaatattgaccgagaaggcagtcattgacctgagtcttaaagaatgaataaggtttttacagatggagtagggtagggataactttccaggtataaggaagattttgtattccagggacctttgaatattttagaatggctagaaaacttggtattatgtagcacagaaaaagtggtatgactgaagagatagagaacttaccacaaagggtcttgaatgccatgatacatagtttggattttcttctgtagggagcaaggagttagtgaaggattttaaaagcaaaatgactcttgggaggtagattcaatgtgaggctaatctccgaggtacaggaaatacaggaaggaggagcaacaggtcgggtagtggtggaagcaggtttggaaaatgtgattagttttgtaaacgtttttgagtttgaattgccactggggaaggcttttggaaatttatttccagagttgaagactgagctatcattgcagtttgctcagctatttactgagctatctactgtcaatttggatagtatctacagtttgcattgtagatactggatacttggattggctggtgcaccctgtttgtgagactcactggagtttgaagagatgaccactggaaaatatccctaagcagtagctgcaattccacccccaccttggagagccaaaaccctcttcgttttcactctcctgtccttggtcttaagctacttaaagcagcctttagacatagggaaaaattgaaagcctctcttttaagaaaaacattaggtacttctggaatagagagttcaagaaattaggagaaaaatgaacttttgaagctttttctttcccttttttgtttacttcattctcttactcagttttaaaatgctggtaatggtcttttttttcttttttttttttttcttggcgattttaatgctttggaaaagatctcatgcttttatctccaaaggaggaaattaatttgatgccatggaaattagttttctagtcgtatgccttgaatgagtgaagaatttctttttcatggtggtactaaatttggggaaagctatagaaactttcatctggaagcttacacttttcctcttttttgaaaatttggtgagagacttggatattttattattttctgtaaaagagtgtaatttgttgtacaggtctaatattgatccttttttggaagtatggaaagaatctgagtataaagcagaattacctctggatggcatgtattctcaaggacactgtcatagtgaaacagtttatttagaagcttgtgtttccaaactgttgaatttgatattcacaaaattggcatgtgtaaactttattaaactttaagctatttcctaagatgaagatgacaaacttggagggaaacttcattcatttggtttatttttatttttatttttatttatctttttgagacagaatctcactctggtttgagacagaatctcactgtgtcccccaagttggagtgcggtggtgcgatctcggctcactgaaaccactgcctcctgggttcaagcgattctcctgcttcaccctccgagtagctgggattacaggtgtgcaccaccacacccagctaatttttgtatttttagtagagacggtttcgccacattggctaggttggtgtcaaactcctggcctcaaagtgatccgcccaccttggcctcccaaagtggagcccccgtgccccttgtttgtgacctgtcaatataaatatgctcagtagcggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagtattcgtaatctaacacagtattgttgccacgagtacgagtatgtgatagactgttgagaataaagaaagcaggcacagttggtcagtcctaagataaaggagatgttttttcttatatgtttgtgcattaaagaaaaaaaaatcttgaatctgaccaatgatgttttttttccttgtaagaaaatttaacaaatgtttggcaagcttctggaatctaaatttgaaattatacatttgtcattttctttaaatatttcttcaccttagctttgattatgagaaatcactgtcctctgctgttctttttttttttttttcttttgaggcggagtctcactctgtgccaggctggagtgcagtggtgcaatctcggctcactgcaacctccacttcctgggttcaaatgattctcctgccgcagcctcccgagtagctgggactacaggtgcatgccaccacacccagctaatttttgtatttttggtagagacagggtttcaccacgttgtccatggccaggatggtcttgatcttgaccttgtgatccgcccgcctcggcctcccaaagtgctgggattgcaggcatgagccaccgtgcccggcctgtcctctgtggttttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcatgtgaagatcagggtcctagagtaacctaatattttgtacattggttatttgactcctcatttttatattaaatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattggaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataaggtatgttttgtataatttggttacttttattgttatgtaccttttttccccatagttaacaggaatgatttgcacaattgcatccatgatttaagcttcctgccattcctttggcttacaagaccattcttaatgaggtatattcttggaagttttactaattggttgtttggaaatcatattgcattttcctgtagaaattatagtgtaaatgatagttaactttagaggctaatcgttaacacttctacaccaaacactatgtctaatactctttctatgagaaaatgcatgaaatacatggaaaattttagcttagcgttttcacacaaataactctcttcactttatttttttattttttattttttcttgagtttttttttaaatttatttatttattattattatactttaaggtttagggtacatgtgcacaatgtgcaggttagttacatatgtatacatgtgccatgctggtgggctgcacccactaactcgtcatctagcattagttatatctcccaatgctatccctcccccctccccccaacccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttaggttatatacccagtaatgggatggctgggtcaaatggtatttctagttctagatccctgaggaatcaccacactgacttccacaatggttgaactagtttacagtcccgccaacagtgtaaaagtgttcctatttctccacatcctctccagcacgtgttgtttcctgactttttaatgattgccattctaactggtgtgagatagtatctcattgtggttttgatgtgcatttctctgatggccagtgatggtgagcattttttcatgtgttttttggctgcataaatgtcttcttttgagaagtgtctgttcatgtccttcacccactttttgatggggttgtttggttttttcttgtaaatttgtttgagttcattgtagattctggatattagccctttgtcagatgagtaggttgcaaaaattttctcccattttgtaggttgcctgttcactctgatggtagtttcttttgctgtgcagaagctgtttagtttaattagatcccatctgtcaattttggcttttgttgccattgcttttggtgttttagacatgaagtccttgcccatgcctatgtcctgaatggtaatgcctaggttttcttctagggtttttatggttttaggtcaaacgtttaagtctttaatccatcttgaattgatttttgtataaggtgtaaggaagggatccggtttcagctttctacatacggctagccagttttcccagaaccatttattaaatacggaatcctttccccactgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattgtgtgaagaaagtcattggtagcttgatggggatggcattgaatctgtaaattaccttgggtagtatggccattttcacgatattgattcttcctacccatgagcatggaatgttcttccatttgtttgtatcctcttttatttccttgagaagtggtttgtagttctccttgaagaggtacttcacatccctagtaagttggattcctaggtattttattctctttgaagcaattgtgaatgggagttcactcatgatttggctctctttgtctgttgttggtgtataagaatgcttgtgatttttgtacattgattttgtatcctgagactttgctgaagttgcttatcagcttaaggagattttgggatgagatgatggggttttctagatatacaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgacgggttgttgaattttgtcaaaggccttttctgcatctattgagataatcatgtggtttttgtctttggttctgtttatatgctggattacatgtattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcatcaaatgagttagggaggactccctctttttctattgattggaatagtttcagaaggaatggtaccagttcctccttgtacctctggtagaattcggctgtgaatctatctggtcctggactctttttggttggtaagctattgattattgccacaatttcagatcctgttattggtctattcagagattcaacttcttcctggtttagtctttggagggtgtatgtgtcaaggaatttatccatttcttctagattttctagtttatttgcgtagaggtgtttttagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggttgaaagtctgttttatcagagactaggattgcaacccctgcctttttttgttttccatttgcttggtagattttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaagttaatatcgttatgtgtgaatttgatcctgtcattatgatgttagctggttattttgctcgttagttgatgcagtttcttcctagtctcgatggtctttacattttggcatgattttgcagcggctggtaccagttattcctttccatgtttagcgcttccttcaggagctcttttagggcaagcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgagggtaacccgacctttctctctggctgcccttaacatttttcccttcatttcaactttggtgaatctgacaattatgtgtcttggagttgctcttctcgaggagtatctttgtggcattctctgtatttcctgaatctgaatgttggcctgccttgctagattggggaagttctcctggatgatatcctgcagagtgttttccaacttggttccattctccccgtcactttcaggtacaccaatcagacgtagatttggtcttttcacatagtcccatatttcttggaggctttgtttgtttctttttattcttttttctctaaacttcccttcttgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttcaaaattttttccaaagttttcaacttctttgcctttggtttgaatgtcctcccgtagcttggagtaatttgatcgtctgaagccttcttttctcagctcgtcaaagtcattctccgtccagctttgttctgttgttggtgaggaactgcgtttctttggaggaggagaggcgctgcgttcctttggaggaggagaggcgctctgctttttagagtttccaggttttctgctctgttttttccccatctttgcagttttcatctacttttggtctttgatgatggtgatgtacagatgggtttttggtgtggatgtcctttctgtttgttagttttccttctaacagacaggaccttcagctgcaggtctgttggagtacccggccgtgtgaggtgtcagcctgcctctgctagggggtgcctcccagttacctcccagggggtgacctcccagggggtcaggggtcagggacccacttgaggaggcagtctgcccgttctcagatctccagctgtgtgctgggagaaccactgctctcttcaaagctgtcagacagggacacttaagtctgcggaggttactgctgtctttttgtgtgtctgtgccctgcccccagaggtggagcctacagaggcaggcaggcttccttgagctgtggtgggctccacccagttggagcttcctggctgctttgtttacctaagcaagcctgggcaatggcgggcgcccctcccccagcctcgctgccgccttgcagtttgatctcagactgctgtgctagcaatcagcgagactccgtgggcgtgggactctccgagccaggtgtgggacacaatctcctggtgcgccgtttttcaagcccgtcggaaaagcgcagtattctggtgggagtgacccaatcttccaggtgccgtctgtcacccctttctttgactaggaaagggaactccctgacccccgtgcttcccaagtgagacaatgcctcgccctgcttcggctcgcggatggagcatgcacccactgacctgcgcccactgtctggcactccctagtgagatgaacccggtacctcagatggaaatggagaaatcgcctgtcttctgcgtctctcacgctgggagctgtagaccggagctgttcctattcggccatcttggctcctctctcctctcttcactttaataatggattagttttctgccttctgctgtggggaatctttttggtaagggagagaagaaagattagttattcttgtgcatcggtatctttttctttttttattgtagtaagaacatctaacatgagatctaccctcttaacaattttttaagtgtacaatacagtattgctaactataggcatgaggatgtgcagcagatctctggaacgtttcactctttataactgaagctttataccccttgaatcgcagtttcccatttcccagtcttcatagcccctggcatccaccattctacactctttctatggggttgactattttaattacctgacacaagtggaatcatgcattatttgtctttctgtgactggtttatttcatgtagcataaagtcatcaaggttcatccatgtttttgcatatggcaaggtttcctttttaagtctgaataatattccattttctacatataccacatttactttatccctttttctgttagtggacatttaacttgttctcacagcttggctattgcaaataatgctgcaatgaatatctcataagtctcgtatatgtccatacaagatcatgaaaatggacatgtctctgggtattttgaattggtgggacaattttgcttaagggtaggcatagtgggtggctctacatttgagagttctaattcccattcctatatatatttcttttctttttatttatttatttttttgagatggggttctctgtcactcaggctggagtgcagtggcacaaacatggcttactgcagtctcaacctcctgggctcaagtgatactcccatctcagcctcccaagaagctgggaccacaggcatgtgtcaccatgcctgactaatttttttttaattttctgtaagcatggggtcttgctatgttgcctaggctggtctcaaactcctgggctcaagtgatcctcatgcctcagcctcccaaagtgctgggattacatgtgtaggccaccacacccagccttatatatgtatttctaattttgccttagccatgcccttaaaaactaattatactttcaactagtttttttttccaccttcagtctgtggtattgttcacattttgaaaacaatacctacagtaacctgtgaggtaggacatgatagtgttttattggaccccttttactttatgaattggaaaaattaaatttgcatgtagtttgtaaaaaaaaaaataaagaaaaaagaaattgattgagattatttcagcagccagaagtgtgggacaggcagggcagttattcctccttctcagtttggaaactgaagctcagagagtaaacttgtcagtgacacagttattcaagaagttgtcttcagttgagagatatgtttttcacctgtagcttctggtattggagcagtacctttttagactaaacaaattacagttaaaattataaaggtatttttggagtacctggaaaaaatcagcattttgcttttctagttccatttagtaggaaggcaggaaagtttggtatacctgaattacatgtgagttatttctatttttctaaaaattcttataaattgtgtaaggtaaaaatgactacttcttgttttatggtaaatatagttatatcctttcaagccactgctgtacaaagttgtgaaatctccctgagcctttttccctcatgtcagcttcaggtatccagtatcacttatgcttgataatgattgtatgaaaatcattcagaattatactatgttttttcatataaagcttttgttttactaattttgaaataactgttcctccattaagcgaatacagccctaagcataaatttggtttgttcatttaaaaatggtctttttttcccatcttatttctggctttactagggagatagattggctgaggttgtcacctaattctgggaggttaagagcctttgtcttttgctacccatttctgaaataaccagaagtctagcccatcctaactttcctctcgatgatccttttcttctttttacttcaaggttccagcccttcatttgactatcagtgctgttcactagttagccatgatccctttcatcctccgtgtctggattagaactgtatttttaatttgatgctgtgggcagttttgatagttacagatcctgtgatacatttaaatgtgtttacaaggggaacaaatgaaacaatgctgcatgaaatttgcctttcattttttttttcttccccttggagacagggtctgggtctattgcccaggctagagtgcagtggtgcgatgtcagctccctatagcctctgtgtcctgggcttaagccatcttcccacctcagactcatgagtagctgggactataggcacgcactaccatgcctggctaattttttattttggtagaagatgaggttttgccatgttgctgaagctgatcttaaactcctgggcttaagtgatctgcccacctcagcctcccaaagtaatgggattataggcatgagccaccacacttggccttttcttttttttatatttatttaattattttattttattgagacagagtctcactctgacacctgggctggaatgcagtggctatcatggctctctgcagtcgtgaactcctggactcaagtgatcctcccatctcagcctcctgagtagctgggactacaggcttgcgcccatgcctggctaatttttttatttttacttttttgtagtgacaggctctcgctacgttgctcaggctcatcttgaactcctggcctcaagtgattctcctacttggcctctcaaagtgctgggattataagcctgagccactgaacccagcaaaatttgcctttcttaaactaatttatctctgttgggtccaagagcttacaagttggttgtcatttaatatgttaaacactagaatattttttagttgaaattttattttttccctttacatattgtatcctttagtgctttatttcactaataagaattatagtatgcaatcatttcccacctctatattcagtatatcaatttttgtttttcctttctacttctgtcttttgctataatttgctgtaatacaggtactttcatcaaggcatccagttctttatatcattctatatttttacttgggagaaatagaaatgttgctaattccatcttactgacaatacctaaattattgtttgttatagaacataatgatttaaatatacaaaacactaaactgtttgagattttttacattttatgtgtgcagaatttacattttatgtgtgcagagacaaaaattgttataagattacaagttaatgtgcaagatgatttccgattcatgagtttcaggttttgatagcatatccttatccactagattagtcttttaaaaatgtgtatgatagggaaaaaatcgagggcatgaaattctgagacttatgggaactaaacttaaatgttcgttgttagatttttttttttttttttttttgctgcatatgaagttttaggcagtcattgtccaacaacattaaatactgaacatatgggaaaagcatatgatttttcaaaatgtttttctaaagtaatctcattctacatacacttaagagcagttataatgctttagtgacacttgaagtagctttttaatgtgatctcaccactatagggaaggccgttgcatgacttttttgtgtgtgcttaactgctaaacaggagaatcttttcctgagcaaccagttgggaaggatttaatttgacattctccctactaggacccccccaaagagactcattccctccaatagttcctacaagttctttctctttcctaaacttgctgttactaatttacccctcactgttttcaaggcaaagcctctgcaaggttttaagtcctttccccctcccgtcctgtccccatcagtgttgaaatgtatgctacagttattatggttgtaatttgttatgccatgttgatcttcttgtgcttttcatatcagaacaatgcatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctaagcaatactagaatggttatatatatatttaagtttgtattaaacctgttggaatggtaaagaaatttactgacatatttaaccatacaaaatagtgttgctaaaagactagtttttctctttattctgtgcatatgtatatatatgaatgtgtgttttttttaagaaattttaaaaaaacttaatctgccagcttttctctattggaatttgcaaacaacttgtaaaattggaattacagaatattagaatagtcagttatggaaagtcacttcattatccttgtgtcactaaacgtataaagttaaatcagaagtgtattaatctctgaatttctaatcagttgtttttagtttgcagaaaaaacttcagcatgtgccaggaacacaacctcaccttgatcaggtaaagaaaaaaaatctaaatctaaaattcctaatcaatgtttttaaaggacctctttaactagataggctatgtttaggactattttattataaactttttctaaaatggtatttttgaactgtgttgataatttttggaatcttaaatgcttttgacatagtctaattctatttcttaacacataataggaattcatcaaaccagatttgttttagaatctgaggaaatcatgctttctagcctttccattctgtagcttgcttagcatattggttagttctgatagggattactccttaaaagcagcctgggggttctataggcagtctgtttttaagtatgttgaattgtttaaggaaaggtctgatataagcatggcttatttaaataaaaattgacttggagtttcaccttcaggtagcactataaatttgaactccttaagatgtttttcatgctctaaaattctaatccctaaggtaaatatctaagatgctaggaacaatttaaatataattttactgtacctgcgtttctgttaagcagatcatagatcgtagagctttaggataacttctttgttcctcttaaaaccctgaggggtggagtgggggatgtgtaagtgagcagtgtgcctaatcttccttcctctctctcaagtgatcactcaatttttgaattgctattggttgtaatagggccaagataacagctacttgcatttgtattcattttggttcatatttatgagcaggtttgctactatgtttgtggcacctttccctgtgaaacttttgttaataggatattcctcttcacttatctttaaaatgaataaatgagagaaatacaagtccttggagatagaatttatggtaaaaaaaaaaaaaaaaacccagttctttatgatagtcggtatctgtcatatagttgaacatgaagcacatttgagcttctgggtaaagaacgtgatgccaagaatcatagggatgaaaagatgaagaaaacgcagtactcacttaccatgaacatttggagcagccagtgtctccatccatagaatctcgaatgaacccctattgtggcagttatgatgccttgtagtttggttgaaatgcttttgccttgcattagtctataaattccttaaatataaaatctttattgctcagtacagggcttggtggatactcagtgaatatttgttaaaagaatgaaaagctgtgtttctcaaatggggtataaatcagaatcacatgtggagcttttttaaaaaaaattcgataactcagtagttctcacccctcagtctccaggattgggacttgggtatgtgtatattaatgtatatttttaacattttattatggaagatttcaaagatataaaagaataaacagaatagtaaagtaaactccttgtatgcatcacccagtttaaatggcatcaacatttagctgattttatttcacctatcctcccaacatttcttttgcctggagtatttaaaaaaaacaaatgtattttaataggaaatttcaaacgtacataagagtagaatagtataatgagcctttatgtacctattgcccttggtgtagtgtattaaagcaaattccagacattatgtcactttactactaaatagggcatatctatatttttgtagcctctgtaggagattctgatgcactgtcctgctttagataatataaacatagggaaaaatagtatcacagccaaagggctatgggattcagaggcatgaacaatttcatttggtttagtggatctgaggtgtaagggaggaaatttatcttttcctcgcctatcactagattcatggctgaggtctctctaacagaagaccaactatcaagagaaatttcaacatagaaatttatttagtaagttttacttgacacaggagccttcataaaacatacctgtgtatgttttctgttagttatgatatggaagaggatagtaatggagaagcataattagataaaacagtatgatctaataataaactgggaagaacttagcaaggcctgtttgctcagatttttctctgtgacccttcatattcagacttaaggatgttcttttcctctgtgtatagagagggcacctcttaaatgagggtcttatgacctgcatcagcggaaggtcagaaaatctttcctaggttttatgacctgcttcaggagagaaggtgagagtgaccttcctgattctgccattttctcaaatattgagttgccatattttgggatagcatgtcctgaaccccatcaaatgcttcatgaggatagtttttcatttgtttcttttggttttggtttatttatttgcatacagtaaagcatgcaaatgtgtaattttagtgtacaattcaatgtttgggttttgtttttgtttttgtttttttggttttttttgagacggagtctcactccggctagagtctcacccaggctggagtgcagtggtgtgaccttggctcactgcaacttcctccttctagattcaagtgattctcatgcctcagcctcctgagtagctgggattacaggcatgtaccaccatgcctagctaattttttttttttttttttttttttttttttttttttagtagagatggggtttcaccatgttggccaagctggtctcaaactcctgacttcaggtgatccacctgcttcggcctcccaaagtgctgggattacaggcgtgagccactgtgcccggcctcaatgtatttttacatatatttgtacctatatatctgtctatatgcacattcaaacacatatccttctaactcccactcaggtcaagatacaaaagatatccaaaattgtaaagagttcctttttgccccttcctagtcaaagaaggggtaagtgctattctgacttacttaacaaaaaataaccttgaactggtaggattttttttgacggtaggattttttttgacgggaagaagtaaggaaaagagcaatacggatgtttaaaaatgagaaggtgagaatcttatagatgagtaggtctctggtacagaagtcttagtggagagttggtactggaatcctggtctaaggtattaggttttaatttgctagacaaagagaactcaagcagtgctgtctaggagtgttatgtaagctagattggactttagagtcaggagaccatgcgggaagatactgtgtgataagggcctgaaacatgttggttacagtgagactagaaatgggataaatccagagctgtttcaccagtagacttgcctgaatatcctgtctgactgattatggatcagaaagaaaagaaggggtgatgggaaacaagcctagattgactagagaaacctagaaatagaaaaatcgggaaggcaaagtgatttggatgataatgccatatattcagttgtccctggtggccagatattatagtatagatattatacaggcaaagaagaacagagggatagagtgtgaaggtacagattttgagtttaagcacattagggggcttagtgttctggatgaagaaaacatataaaagttattgtatgttaggtattgtttgcaaaagagtagaaaatggagaaataacccagtgggttaaagaagaaacagactaaataaacaaacctgagtaagttgttcctaaattttattttagaggcaattcctcattttgctttagttttctcaattattgcctcacttttctgtttctttctctgtcagcatacatggaaaaaggagttaattttagattcaaaacaaaaactggaaaaaaaaagtctgaaatgggtaatacctaggacctagtatatatgtgttattaaggctctatccctgaatttttaatgcagttatctatttttcatggattctttgtttattccccataaggaacacctgggtttggagaatgggaaggtagatgagaaaacccaagtgacaaagaatgtttagtttattattagaaccaactatgagttgtgacccttatcttctgcactgggaattacagattttttcagggtttttctaacgtgaaaagagtttattggtgtaggaaaacatctggttccaaaatatagatcatccttcttgagccccatgatgcgttatcttaatttttaaagccttttgtgtctcatactggagtttattgtaccccttaaaaatattaagtcacatatttaacctgataaaagcaaaaatcattataaaaatctttaggctgggtgtggtggcttatgcttgtaatcctagcgctttgacaggccaaggtgggtggattgcttaaaacccaggagttgtagaccagcctgggcaacatggtgaaaccccatttctgcaaaaaatacaaaaaattagccaggtatggtggcatgtacctgtaatcccagctactcgagaggctgaagtgggaggattgctttagcttgggagttcaaaactgcagtaagccatgattgtgccactctactccagcctgggcaacagagtgagaccccatctcaaaaaaatttattcagttaaaatctttaacaataaagcaattttgagttgtattttgcgacattctcaatatagttttccaacttgcattaaaatacattttaaacatttttgaagactaaattaatttttttaactgacatttatgtttcatttgacaaccttttgctgtatattttatgtggacttttaggtattgtagtgattcctttaatgaagaaataaaataattgtcatttaaaaatgcatattattattaccttatgctataaaaatagttttaaaatagagtatgtttattaagatttaaaaataagtatagtcatgcactgcataacagcgttttagtcagactgcataagattacgatggagctgaaaaattactgtcacacaaatacttaccattgtgttattatttccatacactgttcagtacagtaacatatatgctgtacaggtttgtagcctaggagcaacaggctatacagcatagcttaggtgtgtagtaggttataccatctaggtttgtgtaagtgcactatcatgtttgtataacaacaaaattgcccaacagctcatttctctttatgtatccatgactgtatattttttattgtggtaaaaaacacttaacgtgagacctaccttcttccacaaatttttaagggtacaatatagtattgttaactgtatgtacattgttatatagcagatctctagaacttttcatcttgcatgactaaaattatacccattgaacagcacctcccaattttcgtctccctctgacccctggtaaccaccattttactttctgatttgatgagttttactgttttagactcctgatattagtggattcatgcaatatttgtccttctgtgactggcttatttcacttagtgtaatgtcctcaagattcatccatgttgtagtatatgacaggatttttttaaggatacataatatttggttgtatgtatattaccacatttattttatccattcaactgtcctggacatttaggtggttgttagtgtcttgactgctgtgacaaaataagtacttttaaaagtctcacatttgcaagttcaatttgaacctttttttagtctgcttgcacttctcttatcaagcaagaaagcacttttctgctttttctattactagtaacagtggagattaaatatctcatgtttttgggcgttctagagcccaacacatcacctgttcctttccatactaccacaactgacactctctggaaagtgccacctccctgcagcaggccaaccagcacaaaaatagtacattaaaccagcaaagctaagaaccgtcaaagagtacatttcaccctcctaccacctccactggaacaggtgctggtatccacagctgagagacccacagatggttcacatctcccgactctgtgcagactaccccccagtaccagcctggagtctggtagacttgctgggtggctagatccagaagagagatagcaatcactacagctcagctctcaggaagccacatccataggaaaagggagagagtactacatcaagggaacaccccgtaggacgaaagaatctgaacaacaaccttcagccctagaccttctctctgacagagcctacccaaatgagaaggaaccagaaaaccgaccctggtaatatgacaaaacaaggttctttaacgccccccaaaaaatcacactagctcaccagcaatggatccaaactaagaagaaatccctgacttacttgaaaaagaattcactaggttggttattaagctaaggcatcagagaaaggtgaagcccaatgtaaggatattaaaaaaaaaaagatacaagaagtaaggggagaaatattcaatgaactagatagcataaataaaaaacaatcaaaactttaggaaataatggacatacttatagaaatataaaatgctctggaaagtcttagcaatagaattgaacaagtagaagaaggaaattcagagcctgaagacaaggtcttctaattaaccgaatccaataaagacaaagaaaaaagaataagaaaatatgaagaaagccttcaagaaatctggaattatgttaaatgaccaaacctaagaataaccagcattcctgaggaagaagagaaatctaaacgtttgttaaacatatttgggggaataattgaggaaaacttccccagctttgctagagacctagatccaaatacaagaagcacaaagaacatctgggaaattcatcacaaaaagatcgtcatctaggcacattgtcgtcaggttatctgaagttaagatgaaagaaagagctgtgaaacaaaagcaccaggtaacctataaaggaaaacttaccagattaacagcacatttctcagcagaaaccctgcaagccagaagggattggaaccctatcttcagcctcctcaaacaaaacaattatcagctgagaattttgtattcagcaaaactaagcttcatatatgaaggcaagatacagctttttcagacaaacagcgaattcaccactaccaagccaccagtgcaagaatgctaaaaggaactctaaatcttgaaacaaatcctggaaacatatcaaaacagaacctctttaaagcataaatatcacaggacctataaaacaaaagtacaattagaaaaacaacaaaaaccaaaaaaaacaaggtatacaggcaacaaatagcatgatgaatagagtggtacctcacatctcaatactaacattgaatataaatggcctaaatgctccacttaaaagatacagaattgcagaataggtaagaattcaccaaccaactatctgtcgccttcaagagtctcacctaacacataaggactcacataaacttaaggtaaagggatggaccaagacatttcatgcaaacggacaccaaatgtgagcaggagttgccattcttatattagacaaaacaaactttaaagaaatagcagtttaaaaagacaaagagggacattatataatgaaaaaaaggccttgtccaacaggaaagtatcacaatcctaaacatatgcacctaacactggagctcccaaatttataaaagaattactaatagacctaaaaaattagacagacagcaacacaataatagtgagggattttaatactccactgacagcactgcacaggtcatcaagacagaaagtcaacaaagaaacagtggatttaaactataccttggaacaaatggagttaaaagatatatacagaatattccatccaacaaccacagaatatacgttctgttcaacagcacatgaactttctgtaagatagaccatatgatagccaacaaaatgagcctcaataaattttaagaaaattaaaattatatcaagcactctctcagaccacagtggaataaaactggaaatcaactccaaaaggaaccttcaaaaccatgcagatacatggaataacctgctcctgaatgatcattgggtcaaagatgaaatcaagatggaaatgtaaaaattcctcaaactgaatgacaataatgacacaacctatcaacctctgggatacagcaaaggtggtgctaagaggaaagttcatagccctaaatgcctccatcaaaaagttggaaagagcacagacaatctaaggtcacatctcaaagaactagagaaacaagaacaaacccagcagaagaaagaagatcagagcggaattaaatgaaattgaaacaaaacaacaaaaaaatccaaaagataaatgaaacgaaaagctggttctttgaaaagataaataaaattgatagaccgttagcaagattagccaagaaaagagagaaaatccaaataagctcaagaaatgaaacgggagatattacaactgacaccacagaaatacaaaagatattcaaggctactatgaacacctttacatgcataaactagaaaacctaaaatagatggataaattcctggacagatacaaccctcctagcttaaatcaggaagaattaccctgaacagaccagtaacaagcagggagattgaaatggtaattaaaaaattaccaacaaaaaaatgtccaggactagacggattcacaacagaattccaccagatattcaaagaagaattggtaccagtcttaaagacactattccacaagagagagaaagaaggaatcctccctaaatcatgaagccagtatcaccctaataccaaaaccaggaaaggacataaccaaagaagaaaactacagaccaatatccttgaacatagatgctaaaatccttaagaaaattctagctaactgattccaacaacatatcaaaaagataatccaccatgatcaaggggtttcataccagggatgcagggatggtttaacatacacatgcgcgtagccaaagcaagactaagcaaaaagaacaaatctgaaggcatcacattacctgatttcaaacttatactataaggccatagtcaccaaaacagcatggtacggttataaaaataggcacatggaccaatggaacagaatagagaacccagaaataaacccaaatacttacagccaactgatcttcaacaaagcaaacaaaaacgtaaagtggaaaaaggatacccttttcaacaaatggtgctgggataattggctagccacatgtaggagaatgaaactggatcctcatctctcactgtatacaaaaatcaacccaagataaattaaagacttaaatctaagacctgaaactataaaaattctaaaagataccattggaaaaatcattctagacattggcttaggcaaggatttcaagcaaatgcaataaaaacaaagataaatagctgggactcaattaaactaaagaaattttgcacagcaaaaggaacagtcagcagagtaaacagacaacccacagagaaggagaaaatctttcataatatatacatctgaaaaagaacaaatatccagaatctacaatgaactccaacaaatcagcaagaaaagcagtcccctcaaaaagtgggctaaggacatgaatagaccgttcttaaaaggagatatacaaatggccaataaacatatggaaaaatgctcaacatcactaatgatcagggaaatgcaaatcaaaaccacagtgcgataccgccttacttctgcaagaatggccataataaaaaaatcaaaaaaatagtagatgttggcatggatgtggtgaacccagaacacttctacactgctggtgggaatgtaaactagtacaaccactatggaaaacagtgtggagattccttaaagaactaaaagtagaactaccatttggtccagcaatcccactactagatatccacccagaggaaaagaagtcattatacgaaaaagatacgtgcactcgcatgtttatagcagcacaattcgcaattgcaaaaacgtggaaccaacccaaatgcccatcaatcaatgcgtggataaagtaactgtgatatatatacatacaatggaatactcctcagccataaaaaggagtgaattaatggcattcgcagtgacctggataagattggagactattattctaagtgaaagaactcaggaatggaaaaccaaacatcgctgtgttctcactcataagtgggagctaagctatgaggatgcaaaggcataagaatgacacaatgaactttggggactcagggagaaagggtgggaaggggatgaggaataaaagacaaaaattgggtgcagtgtatactgctcaggtgatgggtgtaccaaaatctcacaaatcaccactaaagaagttaaccaacaccacctgttccccagtaacctatggaaagaaagaaatgtctcatatgtttctgcctaaattggtctttaatactttagcgattctcttgagtttggactataaaatagttttggtctttttgtattttctgctgtaagcctgtatgattatgtaatggtgagtaaaattgctaggccagatacgcagttctaggaagttattcaaagatgtgctttagtatattattttctacctttttaaattcattttgagcttggcttttgagcctctattttccaaggtgaggtgtatgtttttataatgttatgcttagcccttgtgtattttcatctctgagtttgaaatttggggttatattggcaaagggaggtttgggttttaattaggtgacctgttacaggaaatgttaagcttctgtttctttggggtagacagtgagagatttatcaagataaagaagaaaaataaatcctaaagttaatattcaatacatgatgatgtcacccttactaaagccaaagagggcattatcctatcattctcatcgctaagaactcttctcctcttggcacatgcttattcagttaaagataagccaagcctttcttttgtattttttttttaagagaacaaatttacttcggttttgagttttattcctggctctgggtagcttatttttttgacccttattttccccaatttataaaatgaaatagttatcttcactccccaggattgttgtgaagagtaagtcaaaagataaaatgaggtgactcaggcaaaagtacctggccctgtgtagtgagtacattgtatgtgttacatatattcttattgctgagaatccacgaaagaatgaattaaataatgaggaccctttcatcagggtttttgagtgagttttttaaaatacaaggtagtagtttgtgtaaatactaaatccattggtacctgtgcagaatgtaggaaatggagttgctaattccaaaaaaaacagcacatatgctgaggaaagtataatacctaatatatatggtttaagcaatgtaaaattccatgaatatgttccttttcatcttaaaatttgtgatttaaaaaacattgttattactataaagaattattattatttcccttgatttacagagtattgttacaatcacatttgaagtaccaggaaatgcaaaggaagaacatcttaatatgtttattcaggtgaatgcaatttttaactgattaatgatttatcaatggttttgttacatagttgttgctattagcgatggttggtcttattaaaatatgtcacttgatacagaatctcctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgcgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtacacaaagtttttggtaaattaagaatattatttcaaataaattaatttcatccccataggagccagtttatcagataattcgtttctcatttctgcaaatcaatacacaatgagctcatattcagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaaaaacactgaaaaaccatcctaatatatgtattaactttatcattagaaaaggggattgttcaaaaaaaaaacaatacacagaaaccttttttgaaaattaaaaacattaagaaacttcttgtaattcacaaataattgaaattaaataattttctcagcttaagagtttgtattttttaagtgaatatcagtaattaatccattaacattgatgctctatttctgcttttaagtttgaactgaggctgatcaatgttcaatcaattctcctttgagcagggattggtgtcaatcaaagacaaatcacaacaagtgattgtccagggtgtccatgagctctatgatctggaggagactccagtgagctggaaggatgacactgagagaacaaatcgattggtcctcattggtaagtctcaaaggattcacagttttaaaacaaagtgaaaaatatatttgaaagggatatcatgtgccacttaaacagattaaccattcaggtcctcttttaaaactaaataagcttgtggtcaatgtttcatctttatcatgttacaacgttcgtaaaagcttgttaggacttttgttcttcttcagttttagaaaagtggttaatccaaggaccaatgtgactttgatgtactgacctggaaagttaaagatggaatcactcaattactattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctgcattgtaaagttactcttctcccccatttcatactgtgctctttggaaggaaatcactatgcacagcccacactaaaggaatggggagttgtagtgtactttcttgggagtggtctacataattaattgaaattcttctgcaagggacagttgtccctttcgctttattagtttgatcatttatgtttatcagtgtggacacgaatattttatactttgggttacaatttaatactactttattttgttgctcaaattttcccagctttgaccattgggaactctttcagttatctcctgttcccccctttgacatacccccatcaatgtgggttttgtgttttgtttttgagcgcctccttatttttctcttgtatttttaaataaccccaatccctattgaagctggcgctaggaaaactaacaatactccctttcccaggtcatccgattcctatgctgatggaggaaatttgcctcacatgctggggggcgctggggaggaggcgtctgggattatgtggttgaataagacacctggcctggccctcctggagcttagtttagtaggtcacacaagcagtcattggtaaatttgggattcaaacaaatctgttaggctcaaacctgtctgttatttgtcctccaagcttcatataaactgaggagccctaaagggtaaaaacttcaggagcagcaaagtttcaaaaaaagatcagcaagaaagctcttttccagattttatcctgaaggcactagctactttaagctattttttattatattttgcccttgcagttggcgtttgatttctcactgaacattcattgtcataattatagacactatgtgactatcaagggcataatattctttcatgctgcattttttattagatggcacctcaaagttttcccaagtaggtgggttttaaattatgaatatataccgtggcatagtatcttacttagtattttaataagagccttatttatataacaaatatttttttttattcctctgtagtgctactttagtctctgagctaattttcatgaagccaatctaaaaatcgcgttacttctaaggatgtggagcgagtgagatgaacagttgtgctgtcatattgcccctccccagtgcagatagtgaatgaggacccactgatttaaaggcaacactgcagccccttcttgcctcattgaagtcccaagttttattacagtaaaagcacttaatgttgacatttctgaaagaatgaagaggccgggcacggcggctcacgccggtaatcccagcactttgggaggctgaggcaagcggatcatgaggtcaggacatcgagaccatcctggctaacacggtgaaccccgtctctactaaaaatacaaaaaattagccaggcgtggtggcgagcgcctgtagtcccatctacttgggaggctgaggcaggagaatggcgtgaacccaggaggcggagcttgcagtgagctgagatcgccccactgcactccagcctgggcgacagagcgagactccgtcccagataaataaccaaccaaattagctgggcgtggtggcgggcgcctgtagtcccaactactcaggaggctgagacaggagaatggcgtgaacccgggaggcggagcttgcagtggtcctagattgtgtcactgcactccagcctgggcgacagagcgactccgtctcaaaaaaaaaaaaaaggagaaaaagaatgaagagccagagccagagccaggcatagtggcacgcctgtagtcccacctactcaggaggctgaggcgggaggatcacttgagcccaggaattcaaagccagcctgctcaacatagaccctgtctctaaaaatgaattggttataaaggatgaagaaaggaaggaggaaagggagagagagaagcccttatagagtgggtgcatttcttgtatgtggggccactttgtaagaacaggatttttcaaactgggcccatactggtacgtgtgaaatcaacttagttggttatggccatttttttttaaaaggaaatatcagtcatcactatagtgtaagtatattgtttcgtgaaacccatcttagttatgtattatgtctgtatgtgtaagattgttatataaaatgtatttctgtggttaaatattcaaagaaattggagaaccattgctacaaggggacagaggactccgtgtgagctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcgctccagccggggctgcaggtggcccggtggggcggggttgcgcttccccgagagcacatcgagggcggcggcggcccgagtgacccttcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccgcgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcttctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaagattagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatgaaagggaggaagagtgtcctatatcatatttattgttcaacaaaacactgctccacggcttcaattcagtttaaaaaagagaatttattgaacatttaacacatacataaaaggcagtaaagacaaatgagaagagggggggatattgaagtatacggacttcaatgctgagttttacatcttaggaagttactccaccttacagaggctcaatttcccctgatttaggaaggcgatgctaatgggtattgcataggtgtaagtataaaaatgttgtatttaagagaatcccacaagcttggtataaggcagaaaataaatagatgtgacatgaataagtagtttattacatttgtatgctacctgcggactagaggaagcaagaaaaacagccactatgcttgattagcattatagagatggtacaatgatggttgccagaagctggggggaggaagaaatggggaagtattgtttaatgggtatagagtttcagttttacaagatgaaacgaattatggagatggatggtagggacggctgcacaatgttatgactatatttagtaccactgaactgtacacttaaaatggttaacagagtacattttatgttatgtgtattttaccacaataaaaaaataaaataccttaggaacattttcatgaaaaagcccacataaaattcattttaatgcacgtgtttttgcatagctttctatttttctcttttctctttatattccaaattctaatcagagaagggaatcccctctgtacctccaggatattcagtaaagaccactggaggttcatgccctagtgacagtgctcatttagctccaaattacagatggctctagactaactccacaaagtttaaagagaagatttaaaacaacaacagacaaatacgcatcctgaagttactgaactgcctgccacaacactgttcaaaggtagccaataaaaatctagatattcaatagcataacatcaaaatacccccccaaaaaaactctgacatgcaaagaagccataagatatataaaattaagatatatattaacaggataaaaataagtcatttataaatgacagaaaagaaggaaatttcaaggtccttaaagtaaatatattttataaatacatatagataaatacatgtatatgtcaaggtacttaaatgaaaattgaacatagcagaaaaatagaagttataaaatgaaaaatgtgacatgtatagatgaaaaataaatatttgaaataaaaattccatgagatagaatgtcatggattttaccctaacattagaaaatttatagaaaaaaaatagaagctttacaaactaaagtacaagggtaaactaaaataagaaagccagaaactcactgatacgtcagacaacatgcagcagtgtaacatacatgtaattaatgtctcaaaaaggatgggtgggggaattatacatgaataaagaatggtacactcattcctgagggcaccgaggagtgaggatagctttagatttgtaagggagggtattatccattcaggaaggtccaaccccatgaacaaacacctcccagtaagccccacctgcaacattggggatcaaattttaacatgagattggaaggggcaagcattcaaacaatagcaagagttaaatttcctttttaaaaaaatcacttatatgattccatttcgccatagataaaagctagtatttcagcctaccattgagtgtgcttatagctcaccaaaagggcactctgtctcgggaatacagatttgcctacaggtatcctattgcagtcaaagaaagagcaatgagggatagaaaaggttagtgatggagacaccaacgctgcattttgcaacaaacaacgtaaaaattttacggattggttctgctaacttactacagtttacattcctcccgggggagaattgttgcgttttttcttaagatagaaaagcaattcagataatctgaaatctccccaagaaggataagacgcacagcagaaactattctaggcaggaagtcaatcctttcaactgtctgtgctccatagaaacaattgtctgcactgggagtcatatgaggtacagacaacagccagaactctgatcctctcattagtgatttcagaagaaattaccagtcaactgagtaattcactgagtaaagtaaacatttggcactgaaagaggttagacggataactatttgtatcaccatattcatgaagctggaatattttccattactggtatcacatccgaatggaagatgttaaaaggtctctcatcttgtaagatggatatgaaagaacattttctgataaatgaaattattaacacacctgcgaggtggatggaagagaaaaaaaagaataatcagcttgagttcttctccttgataagacaactcactaaaaacataaagagaaaaatacaagtttaaaataattaaccagaagaagacgactctagagtttttaaattgctgataagattttaatttgctccaagttgaaaataattatattgcttgtgttttaaggcacataatgagcaattatatcacacatgatagtttcagcagtaaaatattatcagttaacagctggaactcataaaagcatagcactatgtgaagatggaatttgctaaaataaaccatctgctgaaaactactattctgcaaatttaaaaataaagtttaaatgttatttgtcttatttaataggtctgtgaaaaaatgcgctctttgaaaagcagctgctaccttaattaattctttatattagacggctggttacagtaatgcacagtaaggtgctacatagatatattgctaaattatctgcatatactatgtatttggcttaaattatttgaaattttatagttaaaataacaaatgtatatttaaatgttttgacacaaattgcaaatatacctttaaaaagcgtcttacactctaaatattatttgtcacatatatatttgtcttttctctataggaaagtttaaatttttcccttgaaactttaattatttgagtctataaaacaaaccaaaaatgtacaaattaacaggaaaaaaaggtttacagatatgtgcacaagtatgcacttggagtttacataatatatatatctatacacatatttgtatattataaatagatatacaaatatatactatatatataaaaactccaggaaaggcaaggtagtcaacacgcctatgccgtcttgaggttacagaaaacacagagctgtaggttggtaaatcaggctttgcggaagacaggtgatgacaaggaagaaagaggagcctggtagcagaggtggtcttgttccatggatgaaacctcacagggagcagccctcctcttgggaagtatagataggaaatggtttttagaaatgtaaacgtgccaggctcagttaatctttcctaaacccacacaagggagtatctcaggaaaagactgtctatatcaatgcagattttctctacaaatgcaaatctccccaacaaacacagcttttcagctattcttgtagaagaagctatctccagtcttccgagcagccatcttgaaatatgtcaaaaagctgcccaggcgcacgcctgtaatcccagcactttgggaggctgaagtgggtagatcacctgaagtcaggagttggagaccagcctgaccaacgtggtgaaaccccgtctctactaaatacaaaaaattagccgagtgtggtggtgcatgcctgtaatctcagctacttgggaggctgagctaggagaattacttgaccctgggaggctgaggttgcagtgggccaagattgtgccattgcactctagcctgggcaataaaagcaaaactccatctcaaaaaacaatgtattttagggtaatattttcagtatctttacctccatatatacaataaatattattgtgatttttaatcttttttgtggaggaaacacaggtgtgatttctagtgtagctgaacatcgtttatttgacaatattgcacttgtgtgtgggtgtgtgcgtgtgtagctactctttaattttgttctcacataatgattagatattaacaattaattcagtaaaatgtatgttttgcaatatttctccatgttatcatgctttaaattagtttaatcatgcccctataatgtgtacattttaacctttgactataggtctcaatcttactttggttcctgtatttgaatttatgctaataaagtcctacagctaaaaaagattatataaacttatctacatttttactagtattctggtgtcattttaaattatgtaataaaatcaaattttaatttggattattcttatctgagttaaggatctaaatttttaatattcttataaatattacataattatttctgaaccatatattgactaatctgccctttatatgatgtgcattataagagcttgggattgtttcatttgcaaagatgaatgcttgagaagtagatatttaatcataacgtttcaaaatctattggataacttagaattgaaaaatagcctataggttgaaaaactcctgtagtgaaggaagaaaataactaatatacagtgacaatataaatattataagtatttattttattatcaccctgaaatttgataatacaaacatgtaatatctacatatcatccatatatcatgtcataaaaaatcaatacattcttcaaaaatttagcataacagaaaatgaactctctctccttgatggaattaagttacaaataaaagtaaaaaataaatagataagtagatggaagtagatgtttgaaaacaaagaaaaatacttgttttggataacataaaatctcaattgacaattccaatatttccagaactttgcctgtcaactggtggagagttttccccaggagacatttgtcaatgtctagtgttattgtggggatgtcaagactggtggaggtgtgaaatttagaggtcaaacgaaacacctagcattgctagggcagcctcccacagcaaagaatcctctggtcctaaaggtaagtagcaccaaggttgagaaaccataatctagacagtaaacactacgtagctattccaagtgctcaggaaaacacatcagtgccctcggggggaaaagtgtgaacattttaattgccgtacatggtgacacaaatccatgttgttaatctaagtggaaggggctgaagcacaaaacgtaattcaaagagtttacttaagccaaaatgaggacagctgcctggaagaaacagacccaagtatccttggatatgaactccctttggagctttgcaacaagcagtttcttaaaggcaaaaaagggtccagaagtgggatgatgcaaagaggtttgtcacaaattctcattggcttatggaaatagcatttattagtgactggctatacactgttacactattattgggtgtggattatactatctggtgtggcgttattggttaattaatagctactgtggcaacagcaagcagcctagatgaacacacagctcaaagaggagcaggacagaactgctgtctcatttgaatatctctctgggcctgattatttaaaaggacttgcatttctcacatgaaagttattttcttttctcaatgtccataaatgagaataaatagacgtaaaatagatcttttcgaggatgaagtaaatggaatgaaaaacaaaacccaagctgaccagaaatcatagagggaagaaaaggttataaatatatggatttgtcagagtgattttaagctattaggaatcagttaaatgttgggggattttgtctgagaatgggctaaaggagaatgtcccttttgccttctgaagtttccctgaaaatcactaataggaggcagataaatagtagaaaaggcatacaggtttctgcaatgtgtgtacactggagccattagaacgaagacccagacacacgatgcgtgcagaagcttatctaccacatgaagtttacagaaagaatggggtcttggatcacaggaaaaaaaaaaaaggttatgtgagaaaacgaccctggctagcaacagtggactttttacataggtgaaacctcactgggagcagtcctcagaaagaatagacagaaaatgtttctttcagacctttggagacctccgatgctcagttaacctttcctagatccagacaagggggcagacctcagagaaagcctggctgcatcaaggcagattctctaccgatgcaaatctccccaagacagctttgcagctaagtttgcattcccagcccttctcaatagccattttgaaatatatcaaggaaatatatttaggggtaaaatatattagtttccttcatacagctataaaacatacaggaataatttttgtcaatgtctactacaaatccaatgtagcagtaattataaaacccactagatattgaagaaaaaatatgtagagtacatcaattacaaatgttgatactaaaatgccaaataaaataaaaataatatccaacaatgtttgaaacagtaagacaagaaattggcaaaaaaaaaataaaacaaatatccaccttggggatgaaagtgtgtttccaaatttggtaatccaataatattaataataatattgattagcccaaattaaaaataaataggggattctcagtacatgctagaatatatttgttaaaaggcaatattcatgtctgtaaagattttaaatgctgtaaagagtctgatattctatatgcaaacgtgtgtatgtccattagaagaagagaggcctgattttcatatgttactatatagagatagagaagtgggtagattaatttgcatatgcatagagaaagcataaaatagaaatttactatcatattaaaggaattttaattcaacaataaaataattcaaaggtaaaattttaaatatttttaacaggtacattattaatattagataatatttatgataattgtgaaaatattcaatgctaaaataagatacaatgtctaaacatcagtattaaaactagtataaatatttgcttgtttgtacaaggaaaattcaagctcgacctaaaattatataggaaataaaagaaaaattttaagggagctctttaataacataaacatatatatatatacacacatatatagcatgtatatatgttatatgggatagatatagatttaacatgttatatctatatttgtatctataactacagctgtatgtatctacatttctatatatttactcagtgatataaatatagactggaataaatataaagacacatattattcttggataaaaaggatttagtatcataaagataaattatttccaaattcacttatgaattcacaacaatatacagtttcattagtataatttaaaatttttaaataaattccaggattcatttaaaggaatatacatgtatacaagcagtcaagaaagaagcaagagtgcactaaagtaacttgctattgaaatacatttttaaacttagtaactaaaactgagcagtactgatttggagtactggaatttaggtatatgggatctcaaaagcacagagctcaaaggagacccctgtatgcacgagagcttaggatgtgctttggaaggcattaccaaaccacgggcaaagttactttagtttcttagtcttactaggtttgaaaagccagagaaaagactcaagaccaccatataagaccaaaacaaaaggacagggagagaatgtgaagatactgaaacttttacataaagttgtataaaatatcctttaaagaaaatgtaaagtttaggatatacatcaaaatcagcagaaccactaaataaataaataggcattgtaaaatagcaagagaaaatttaaatggatttctaaaaaatattgacacctatgatttttaaaatatgtttaagatatcccgtatttcgcagggcagcctttcacaacacagatatgttaggacataaaggttcttctgtttttaatttactagtgtttatagggtaacaaatgtcttctacccttgtcttttgtctgatggtgcaaaaaattttcataagcatgtatttctgaatgcctgatggattgacatatataatatgctgctagtattaaaatatgtgacggaaaacgcatccaatcttctcactgtttacataaattctaggtttctcctatttacctcaagcacgtatggagcgaattcttaccttttaatattgccatggcattcacattgaacataagttgaactctctcatatggtagctgggttcagattcccttgacaatttccaattctaaccctcacagttcctcagtgtggctggcctagatattgaccctacacagttgcctcctcctggtgactaccagctatggaaccgttggatacaacctacctgactcaccccacagacctcacagcgcacatggacagcccccacacgccagagtgacctgctcggttgcagcgggagtcaagaaatgtgcctgctggcactcaccccacagactagtgccccgtggaaaacttatttgggtaatgttctgggccgaataaaggctggagtcccacagaccccttttctctctcctgctccccactcatcttccccattttgttcagccctatgaggtgtgctactgtattagtccgttttcacactgctggtaaagacatgcccaagactgtgtaatttccagaagaaagagttttaatagacgcacagttccacatggctgggtaggcctcacaatcatggtgcaaggtgaaaggcacgtctcacatggcagcagacaagacaagagagcttgtgcagggaaactcccctttataaaaccatcagatcttgtgagacttattcactatcagaagaacagcatgggaaagacctgcccccatgattcaattacctcccacctgttccctcccacaacatgtgggaattcaagatgagatttggctggggacacagctaagccctcttctcagctaccctcttctctctggatctgtgagtaataaacctacttctgtgatttcccatgtttggttctgtggcctccatgggtctgagctgacctacactggaacctaactctcctcctggccagggtctctgagagtggctcttgtcagaaatacacaggacacaggtcaggcaacagtcaccaggcatctcctagtctcaacagatgttctgtgagagggaggcttggtcgtgggatgcacatctggccactgctggggtaaggaagtgtcctgtgaaaggcacatgttaagcatccacaaccccctgaccagaaccccagaaaggcagggctccaattcacagtcactctccagagacaaacctcaagccctaactggaggaaaagaaaacaatgtaaaaagttgaatttatcttactatttcaatgatccagtaaagacattctatgcctgtacaccacatattttcttcgattgtggatttattttagatagaattttatgtctggctttcactttagcctggtccctacctcaagcataaggtaaagattttccatgggttcttttctgatactactatctgccagtgtggggtcatgtcctagtctatcttgagggaatccccctgttcattattgtcagagtgagactgttaagtcttgatttccctggacaacttcactgcatgacttttaatatgattttttaatattccctttactggacaataaattatatagttatctgagtaagagatatggtcaggaagaggcattgcctcattcagcttttctctttggtgaactcgcatatgttctcctcacccgccagtcacctctaaaccgtattgttccaagacaacaaagagaactcgagtgtgtatctttcaccactggatttgtgtttgctccataaagcttcatgcttaatagggtttctgttagcattttctctgtttattttcccataaaatatcacaggcctttttcatatggaattatgggtgatttccttcaatttgcatcatatcaagttgaggttcatgttgatgaaaagtaaaacatacattgaaaatatcagtaatgatgttttcccctcctttttagcaccagtgcttgtgatacaagcacattttaatacaattgtagtctcatgctttgatcattcctatgatgaaaataacatttttagataaaatatctgagttttatgaggcctttagtatgtgatgtgatagaatatcagaagaccatacttttttctagttttctgtgcaattctatcattgtttcatctttactcctaccagagtaattttccaaaatagatatcttgtcattcttcctcttgttatcagtaaataagtgaaatgaaaagctagattatataatttatctagaacaagaaagtagaattgaatctacattcattaatgagactaaccagtcaattacacagataagcattttacatgttgaagatcatatggacccattgtcagaaatattattatttatgtctatatggacatcacctgtgcatatttacatagaaatcaatgagagctgatttttatttttattatatatattttttgagatagggtcttggttttttgcccaggctggagtgcagtggtgcaatcactgctcactgcagcctcaacctcccaagctcaagcaatccttccaccttggcctcccaaatagctaggacaacaggtgcacaccaccatgcccactttttatttttttaacttttgatagagactgggtcttgctatgttgcccaggttgcttttgaactcctgggctcaaggaatcctctcatttcagcctcttcaactgctggtattacaagcatgaaccaccatatgggccggaagctgatttttaaaatactgagatcatatagacgacaacacctgaaaaatagacaacaccaagctttatgttaaaaggtgtgagggtatcaatattgttgtggctattggggaggaaaacattagtaaaaccagtgagttaaagctgttgctttaaactttggctttaatttaacaaatgttctatggagtgacagtatgtatgtaaccatgctatgcccattcacagatgcagtagagggaagaatttctcaaagacaactgttctaagactcaaattaaaccgtactgggtttgaaaagagaaagtccagggattaccaaatattttagatatcagataaaagagaatgccagatatgcgatgataatcagcaatggttgttcacacaatacatcaaatcagtatttgaattagcttttgaattacaaggacaaatggaccaagtctagactccttagtagataaatcttattaggctgagatgtgttttcccctgtttttccacaaggagattacaaatttgcaaacctcagctgctctcattttatgctctcaccaagctaaagctgaagttcatcaatcagtgtgtctaagtgttcactggttatataccattttgtagtttcagctatctttccagcttcctaaatcatcaccttcatttgatcttgtttttttccactatcacttctttattgaccatataaagaatataagtgagttcttattttgttattgttcattttagtctaatttcatcaaaatatcacagtcttttaatttcattttaatttcaaagattaaatgaaacctacatagaaatgtgtgtaagatttgcatttgcattattttggcatcaatttgctatcctccctcatgcacatagagatcatttccacgtacgtgatttcaaacatccaagtgcagtattaaaagcagttgtaaattatggttctcattttcatgatacaattacaatataaacttcctcttgctgctgtaaccaattaccacaaacttcatatcttacaataaagtgaccgttaatcctacagttctgtagttcagaagacttgaatgaaactcacagggctaacatcaagttttgggcagggctgcagtctttctgagggctatgtggcagaatctattacttgatttttttcagcatccagaggccacctttattccttggaacatgacctcattcttatatcctatttttcttttttttttttttttgagatggagtctccttctgtcacccaggctggagtgcggtggcatgatctcagctcactgcaacctctgcctcccgggttcaagtgattcttctgcctcagcttcatgagtagcttggactacaggcacttgccaccatgcccagttaattttttgtatttttagtagggatggggtttcaccatgttacgcaggatggtctcgatctcctgacctcgtggtccacccaccccagcctcccaaagtgctgggattaggcgtgagccaccgcgctgggtcctcattcttgtatcttaaaagtcagtgatgttgagtaatttctcatgccaccacctccaaggttgcatttcttctgtcttcttctttcacttataaggaagtttgtgatttcattgatcccacccatttaagacaatctctctatcatttttccgcaaccttaatttcacttgaaatctaatttcacactgccgtgcaacctaacatatttgtatgttagactctgggaattaggacatgaaaattttggggaggccattcttttgcctgcagcagacataatctatttacctgcagattaaagcgttctttatttttctgtctccctctcttaattttttaaaaataatatgaattgtagtaaagagaaagaaaagaaaacaaagaaagaaaaagaggaaggaaataaagaaagaagaaagaaaagaaggaggagatgagggaaggaagggagggagggagaaaggcaggaagggagaaaaaagaaaacatgaacacaagaaagaaagagggaaggaaagaaaagaaagaaagaaacagaaagaaagagagaaagagagaaagaaagaaaggaggaagggaggaagaaaaggaggaagagagaatggtaaaagggaggaaggcaaagaaacaaagaaaataaagaggcgaaggaaggaaggaaaaagaggaaaggaagggagggaggaaggaagaaaaggagggcgggaggaagggagaaaaaaggaaagaaaacaagaacgtgagaaagaaagaaagaatacgagaaaagaaggaagaaaagggagggagaaaggaagggagggaggagggaaggaagaataagaggaaagaaagaaagaaggaaagaaggaaggagaaaaaagaaaagaaagaaaggaaaagaaaaaagaaaagaaaaggaagaggaaaagaagaaaggaaggaagaaggcaagggaagggaagagaagacaaaggaagatggaaagaaggaagaccgcaaacattagaaattctgtgtttgttagagaatatgccatactgtttttttttcacttgaaaggaaagagtagctgccattgaagattggatgtcttgttggtgatattgttgttcttatcttccacatgattactgagtttgtgcctagtctttccattactaagacaaaagtgttgaagtctgcaaatataattttggatttttctagttcacctttgattctttcatgttttacctcacgtatttggaggctctgttgttagctgcataccctaattagtaggatgtttacatcttcttgagaattgattattctattatctattatctctcatctctgatactatttcttgttccgaactctgttgtgtctaatatcaatgtagtccttccacagccttattttagtgtttccatgatatggctttctccatatcttgatgataacctatttatatctctatatatttggagcaagatataaaatttcgacttgattttttaaagatttttcaagatggaattcttatttctttttgttctatttgacattctctgagtttcctatatctgaagtttgattttctgtcacttcttttagaatatttttggcagttattttgaaatatatttcttttgctccattattttttcctcttttctttttgggatttcaatcataactagagtaggcaatttcatctcagtcttatgcaggtacattttctcagggtctcaggaatgtagccttctcacacttctgttcttttcctggctgtgttggtgagctcagtgatattcctccttcacctttaagagcagttttgttttgtttttcctgttttcatactcccagcatcaggagtattctaagtgtggcagtttttgttgccttcccctacatattaagtggaatatcttggtctatttggacccttataacaaaataacataaactgggtgactcaaaaacaacagatatttcttttttcacacttcttgaggctgtaagatctcaggtcaagatgctcacaaattcagtgttgatgagagcccatttcatggatcatagatggtgccttctttctatgtcctcacacagtggaagtcacacaagaactccattgagcttcttttataaaggcactaatcccattcataagggctcggcccccaagacctggtcacctcccaagtgttctgctctccctgatctgtgtcatatacagactctcttggattccttaccaattgcttgagagatcacagtgggtttgtggggaaaaagttttcaagatgatggatctttcccaacttctgcaactgtcagcggtctcccaatctcaccagccccactttgtctttaggaatttattgattattccagctttacttgtcatagtggtgtctatttgcatctgtcctatgtaagtgcatctgtcctctttctccttgcaggtgcttgttttccctcacattttgactcagttcttggcaacctggttgctctaaaaataaagtcatgactttgaagttagtttggttctttcattgttgtcaggttaggaaccctattccatcccagatctccaaaacccagactttttggggggttgaaatgttaggctttctctttgaattgtagttttatcttctttcagttaccatttgcattttcataatgattaatgagactaagctttttttgtgtagttgactgtacctttggatttttttcccaaatacctttttatttcttcttttctttatggttttagaaaatgtagtttacataattgcagcttgatttgttactcagttaatggcatgcttaatggagagaaaaaatattaaatatatttccctttttaattactgtgcttttttcttttttaaggaaatgtttcattatgttaaatttcaatgttattctacttagctattccttaaatattataatattttggatttcacatgtacatttgtaacatatcttgagtttattatgtatagagtaaggctattttcttttttaaggtaaaaatcacataatataaaattaataacaaccattttaaagcatacaatgcacttgcttttagtatattcacaatgttccagggcaatttcatcatgtcccttccaaaaacccattatgcataaagttgttacaccctattctgcttccctgagccctaacgaccactaatctaatttatatcccaattgatttgccaattcctgatgtttcatgtgaataaaatcaagtaatatttgtccttttgtgcacttaacataatgctttcaaatttcacccatattataacatatataagtacttcattctttgttatagctgaaaattaggtgtccatttatgagtcaacaagcgtatggattgtttccactttttgactgtatgaatattactgctgtaaatattcatgcacatgtttattttttgagcacctatgttttgtaagattaacagctgacttaagagaaacaatggaaggcaagaggcagtagaataatatattcaaaagatgcaaaggaaaaaaaactctcggccacgaattccttatccagcaattatttttcaaaaatgaagataacacaaagacttacccagataaacagaaatattaactgaagttgttgctggcagacctaccacattaaaaaaaacgctaaaataaattcctaaggctaaaagcaagtcacagaagacagtcacttgaatccacatttttaaaaaagtactggtataggtaacattgacattataaaagacagtaaaaatgcattttttctctttatcataaattgtttattaaataacatgtgtataatagccgggcacgatggctcacacctgtaatctgagcactttgggaggccaaggcgggcgtattacaaggccaggagatcgagaccatcctggctaacacagtgaaaccccgtttctactaaaaatacaaaaaatgagccgggcgtgatggcgggcgcctgtagtcccagctactcgggaggctgaagcagaaaaatggcatgaagccgggaaatggagcttgcagtatgcggagattgtgccactgcactccagcctgggtgacagagggagactccgtctcaatgataataataataatatgtgtataatgtattgctgagtttttgacatgtagaaatgtaatacgtctataacatattttccagtaacatcaaaaaggaggtagttggaagaaaaatgtattgtgataaggtaatcactctagatggtaaagtaataattactaaaatgtattgttggctttgtaactttaatagatgtaatgtgtaaagtgataatactttaaaatggaggaaataaaagagatttatataagaatgatgtttctatgtattaccagaagtttactagtataaattggaagatgatttgaataattaattttccatatacctatatggtaaacttacaacaacaacaaaaattctcaaaaatatataataaaataattcattagtaatctaaagttccctattttagaaaatattctttcattgcaaaataaagcaataaagaaaaatatttgagaaatatataaaacaaacggtaaaatggcagacataaatagaattataccaattataatcttaaatgtgagcagattaaaatccattccagaggcagagatagtcagactggattaaaacaagtgatcccaatatacgctgagatgcaaggatactaatggattgaaagtaaaaagatgacaaaaaatatcatgcaaagagcaatcataagaacactgaactcattatactcataacacacaacatagactattaaaaatgtgaatagaattttaaaaattatattgtagtaaaacgggggtcaacgctttaggaagacatagctattacaatcatgtatgcacagatatgagctaaattgtttcctttatatagatgctgaaattctaaccactgaatatgacctcattaggaaaataggttctttgcagctgatcaagttaagatacaatcagatgagcctgaattcaatatgactgatgtccttattaaaagaagagatttgagtagagggagacatacacacagggagagtaccatgtgattatgaggacagagattagccaaggaatgccaaagactgccactaaaccatcagaagcgagaaacaaggcacagaacaggctttctctcatagcccttgaagggaccatccctgctgacccctcaatctcagacttttagcttccaggactataagactataaatgtatgttgttcatggcacccagtttgtgttacttggttatggcagccctaggaaactaatacatgaactaataacaaagcataataacatgaagcaaaaattgacaaaagaggagcatcagcaaaatggcagtggagacagctgcaatctttcatttccccacagaaacatcacacaactaagagaaactgtccaaataaactttgccaaaactctggaaaacagtcaaaagattacaacaaccgagtgaaagcagactcaagaaaaagacaacttgaaaactttatgacatttttagcttgcctttgccccagcaaattggcagttttgaagtgtcagaagcccacgttcccagtgaggaacactggtctatggtccaaaggaacaagagaagatcttacccgcaaattactatgtgtctgttctgactggtctgggggatacctaaaggactcatgaaaggcttttgtttttctgtgttgctagaatacagaacagataaggaatggacattatcaaggaactctgcaaggagacctaacaaaccacagatgcttagggcaaaaattagagtttacacatatagtagatcaccttcagcacaggaagaaaagttggagaagagtatttggaaaactaagacattcaaaattattcacgtacatgggagagtctagaaagtcacatgtatgcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctagaagcatattttgctggacaatgattacttgtttttctttttgtttttgttgtatttgcctctttgcttacttcctgacatacaagaaaatcactgtcaaaacattagcttaacatttgttaaggaaacaaaaagacttcggtgaccacaccttataaagcaaacagttttgtaaatcactttggaaaatttcactaaaaaaaaaatccttaacaatataataagtaaagaaaatttaaaaccccaaaacattactgtgtttgtaggggagggtctgatttacagagtaaccacatagtaattataattattataatgcccagttttcaaaaaaagttacaaggcatacaaagaacgggaaagtatggctcattcaaaggaacaaaacaaactgacagaaaatatttctaaggaaacccagacttcaaacttaccagacaaagactttaaaacaactctcttaattatactcaaatgtcgcaaggaaagcataaacaaagaaataaaggattcagaaaaaatattaaaaagtaggaatatcaacagagatagcagaaattctggagtggaaaactacaatgataaaaatttaaaaatcaccagagggatttaagagtatatttgcacacacagaggaagtcatgagcttgaagataagaaaatggaaaatattgactctgagaaacagataaaaaatgagcagagactaaggaatctgtgggacatcatcaaatagaccaacgttcatattctagaaggataaattatgttgttgaaaactttagcattctttcttttcaccttcctccctcttcctcctcctttttacttttcttcctcttcctttctcttcttctttctctccttcattatccctttcgctctgtttctctttctccctttctctttttccttttctttcaattttctccattactaagagatgtttgaatacccttaccatgtgagttgatatggttatttctccatttaatcctcttttgagatttatagtctctctaagtaaagagataacccaaacataagcctcacaaacaggcttccataccattcttaatttggtcctgtaattcttcattgctgtattaactttctgatgcttttaaggatgttttacaacaaattgtttagttttttccactggaatgtttattctcaattatctaattcatactgtaagtatagagggagtttaatataaaattattaaactaatatttgtgaaagaacgtatttgtgcatttaacaaatatgttaatcctcagactgttattgggcagctgagcatacagcaataaaaataacataatttttatgtgtacaatatttatggaatacgttactggaacaaataaataatttagttaataacatgacaaagaacagaaattgtatacactatagagcatagtaatggaataatgattgaagttattaatattaggtagaaaatgaagggtatctttgagagcagaactcaaggaaacaagcaattcgccttatgaggaaagagttacctgtggataaaggagaaactgaaaaatttacaagtcaagactttttgtgcaaaaacaaaaatatgattattagtcaccaattcagtacagtgaaaaaaaagttgaagagatatcttggaagtaaaccatattgtggaagagcatgtagggttttgataatcaggggattattctgaattaattttaaatgcgataggaatatatgagataacttaaccagagaataacatgattgtgtttgcatttcaaaggggtgtatcttgtgcaccgtgtagaataaataggttttgtgagcaaataaattgggaggctactctaatccagagaaaaaaggtagtgacttaggtgagaatgctgtcaggatgagtggtagtagtggtgagaagtcattaggccatggatgtatttcataggactagccaagagaactgcagctaaattggagtgtagggagtcaaatggagaactcaaagatgactctcagcactggaaagtgacactgaagcatgctgatgcctcttattaagagagttacttgggaatggcaagatcaaaacttctcactttcaaatttatgaaaaatattgttttcagaacgaatgactttgggatcagaaagccatcattctaattgatggttccaagactacacgggctcacactcccaagaacaaaagtaaatcatcacaaaggtgcttcctgataattctagagaatggagaattactgtaacatctttctgattttaggagaggtagcagttccccgtttagcctaaacgctatttttttttaaagctcagccaagagactccattataattttcaaatgtgtgtaacttaaattctcatatgaaataccactatgcttaaattagtcaaaacattttccccatctacaactctatcttttcattgcaatcattttcacaaaagtgtctgcagctcacagaccctaaaaggagaaaatccagggtaggttatctgatctagttttgaagacaggatctagagattatttaatatgaaataggtcacctgaaatgaagtgtttcctgaaaacagcttggatcagcccagttttctaccactgaaccatgcatttggtttaaaaaacacaacaactctggggaatatcggctgcttccaactgtgttgaaggtgttaaagaaaagagcataaaagtaaaaatgatcatctgaggcctttatagtctctgctcaagagactagagtcttccattcttaacgaaacacccaaatatcttaataattgggcaaaatctaaatatcagagagataattttatcttgaagattgttaaattataatggtgattcactaccttgccacgtctctgagtcaaaaattaggtctttgtttaggaatcaatggtactctgcaacttggaaataggaagattttagaagactcaaacactgactttcttgtgtgcaaaaaaaaagacgtattgagttaagacaagtctttccttgcaaggatacctctaatgctcatacaccacctcccctaacgttaatatagcttccaggtcagtaaccagtgtcagagagcagcccatgcaactacaaattcaatagatgtcgaacacagggtcaagcctagaataagaagtcttagctaattaagtatgctttgttccccaaatttatattaacaaaaacttggatatgtcagagaatgcattctaagttcactcaacctaggagggagaaacataattttaaattaagagctgaagcattcttgtcctaacaaaaagcaaggaaaatgaaatatcacaccacaggagggatttcacaaattagtgtcaacatcaaaaccttaaaataggcaaggaaaatgcagatttacaatgaactcttgtacttgttttgttcagagaagagatggttctgagagaatgacagtgaactaaccccagctggtttaattgatgctttcaactgctgcttctgatcaactccttcagctagaataaattgatgaggattttggcatgtggtattagagatggttattttttcctcttatttgcattgttcaatgtagtaaatactagctgtatagggctacttcaattcaaattaattacaatgaaatatacttaaatattgcattttttagtcactgttggttcattattgaatatcttcagctaagatttcccatctaaatacactaagaggtggcttagttaactggtcgtccacaaatattgacgctgatgttaactcctgatatattctctgcaaatagaatattcatgagcctcctcctgaaatcagcagcctagagatagttttataaattggatacaagttggaaatctatatactctttcagtttttgaaatattagcttcccagggaagaaaatcaaattcataagctatgttaggacgatttaactcaagatgttcaaaactgaaatgacgtattctacaatatgtgataaaaccaccccctaacaacttaaagcaaaacagggattgaccttaaagacctgccttttcctcatcccccaatcagttttcaaatctcgcattttatttcaaaaggtccttatccccctagtctcttgtttctagactcggcacatatttaagtttgttacctctatctactgacatttttctcttcgaacggtatctatgcctgccaaatgtgaatatacaaaaaacaaatcagaatgtgccattctgatttaaactgcttattagttaaaaccctcaagataacatctgggttcttggctgcaatgagtcaagcctacttacatctttttttgtctttggctgcacatttcctatcacatcacactccagcaaagccaagctgtgccggccttctaccccatctccactattttgccccgcgtcgccgcggctttttgaccctcatcacagcggctcttttgcccttcgccgccgcggctttttgccccaagcaccacctcggcttttcccccgccgccgcggctttttccccaccgcggttttttgcccccacccgccgcctcgggtttatgcccgccacggcttttagttccctgccgccgcggctttttgcccgacccggctttttgccccccaccccccccccgccgccgccgcggctttttgctcgacccggctttttgccccccccaccgccgcggcccccgccatcccttatagctgtgccggccttctaccccatctccactattttgccccgcgtcgccgcggctttttgaccctcatcacagcggctcttttgcccttcgccgccgcggctttttgccccaagcaccacctcggcttttcccccgccgccgcggctttttccccaccgcggctttttgcccgacccggctttttgcccctcgctgccacggctttttgccccccgccgccgcggctttttgcccaccgcggttttttgtctccccgccgcctcgggtttatgcctgccccggctttttgccctccgcaactttttggcgccccgggtgccgcggttatttgcctgccgcggctttttgcacccccgccgccacgactttttgccgcccgccgccgcggctttttgccccgccgccgcgcctttctgcccgccgcggctttttaccccccgccgccgcggctttttgcccacccccgctgccgcggctttttcacccccgccgccgcggctttttgctcccccgctatggcggctttttgcgccccacgcccccccgccccctgccgcggttatttgcccgcggcggctttttgcaccccaggcgccgcggctttttgccccccgcccccgtggctttttgccccatggccatcctcagaagcgtgagtggaacagagtgaagggaaagctgttttcttcgaaagctcaaaaatcttgaactttcaaatagggataagtgttatttttgctccaagcacacatttgagaaatcttccatttagcggatatgatgataaacccacattttttgttttaatctgaaaatgtatttgtatggttcttggaaatattttttttgcatataaaattatagtttatcatcttatttcaagttttatttaccatttgatagttactcctaaaatgtcattgattaaagaatcatctattgctccaactgctctttactaaaggtaatttgtctttttaacctcatcaggctccttttaagctctcaaactgaccttatatttttttacagattgaatgcattaagtccatttattatttatgatgaatttatttatgtatttattttcgctatcacaagtagaaaaagcctataagttgctatgccaaaaacctgcctctagatggcaaacaaaccccgcaatacacaaaagagagccaaattcttagaaaccctgggaaaggaagagggctactgtcccattaacaacttggagcccttaaggcaagaatgaggtggaacatctggggggagacaccagggtgcggagtagtggggaacctgctctgtgctctgagactgaaagcccagccttgcctctcaccactgccttgactgtgtccccatctgctgtgaagtgaatggtgtcttctaaattcatgctgagccctaattgctgaaaagtgtaagacatgcaatggggggattatgtgcatcttcctgacaccaacatgatgctcaggaaggagacttcttgttttctcttaggattcttttactaaccaagattttgcctctactgcatatttccctttgctgattgtccctcccttttgacagaagatggcccagggcattcactactaagtctcaacctcttacccaaagccctcagtctagtgttgctctttccttcatgctatttttgtttcttttcttgtcatcatcttggcaataaaatagtcacttttttctttctacctattaaagatgttaccttagttaattacagtggtttccttcagaatgataaatggtctttcaaaatgatgtaaagagatctaaatccgtgtgctccagaagttgaatgaagctctgtctagcacgggtgccagtgactctcccagagtgctccatgcagctggacccacggagtccctctgtgctgtcatatcacccactgccttctgtgaatgagatattctgattggaatcctggtggatgctatttgagccatgcccccacaactcctatgaaagccgaggaccacaggcccctgaagacaatcacaggtctctagactcacagctcatgaccgtactctgcagacacagcttctccccggatggctgagttttgtcattggctgtgtccttccttgtgcatgacaacaggagacatagaaggtctgtaagcagccctgcaagccaggttctgagcaagccctcctgtgtggggccctcttacctggacataggtgtgtaaaccaaaaatgaaactctaagctccctaaccaactgaatgaactcctcctctcagccaaggacacaccaaaatcaacctgaaatacaatacagtccatgatcggaacggatgattggacatgccttaacttaccctcttccctttaaaattcaggcagaactgaccagcttttaatatgaagacagagaccttgagactgacaaagaaaactctttatagcaataagataccaatgtgacagataccacgtcctaagagaaatcaaagtattttccccaagatattgttatttaatgtatttaaaaatgcctctgcaaagctggtttttgtgggagaaatctaaattctgtagagattcctttttaagtctctttcctgacccagagagatttaactaagagtttggcaccttttaagtctactaagaaacaattacaatctattctctctgaagcctgctacctggaggcttcatctgcatgatgcaaccttggctccaaaaccctttttctaaacccagaaactcccttgtgttgattacaggtcattagataaactctttcaaccacctatgaaatctttgaatccacctatgacctggaagtccccaatatcccccctccttcgggctgtcctgcctttcaatatcaaagcaatgtacagcttacacgtattgattgatatcttatgtctccttaaaacgtgtaaaaccaacctgtagcccgacgacctttgacacacgttctcaagacctcctgaggctgtttcactgatatttctttaactttgaccaaataaatttctaaactgattgagacttttctcagatacttatttgtttataggtatcacaggatacacttaaggaattgaagagatttatgacattgagaaaaggaggaagccagggtgtgtggagagagagagagagagagagagagagagagagagagagagagagattgtgatgtatgtacaggactaacactgagacctggttatgtaatggtgtagtaatgagtatcatccccaaatagtgaggtttcattccaagaagactatgcatgtatctcatttgggaaaacagcttttgcaggtgtaaattaaggagcttgaaacagggagatggtcttagattaatcaactgggacttaaatgcaaactcaagtgtcctaataaaaacaagaggtagagagacatttagcatagactgaagtggagaaggcagtgtgaacacagagacagagattgcagtgatgtgtccacatcccgggagagagaagccaccagaagctggaagagctaaatcagactgctccctagagcttcagaaggagccagaactgatgactccaagatcttagcccagtgaaactgatctggacttctgaactatgagagattccattcctgttgtttgaagctaccacatttttgagaacttgttacagtagcccgaggacactaacacaaatggggctccgggaaaatccagactaaaggtgttgtgttggtttgcaatctccttgcttaactttctgatactagacgtaaatagattggtgaaaaattttgtgaatgaagaaatgtacatgaaacctacagtgtacagagaagcatctgttagttataagataaatattgataattttagttgaaaatgacatatgactgttaatatctcacataacattctgagttactcaagaatgcataaaaggggcactagatactcttctcatgtatgtgtgtgtgtctgtctatacatgtatgtacacttcatggtgcatcagctggcagaaccctcaggacaccccttcacatcctcagtgccccatttcacacatgaggaaactgttcatgacagcacatggctgatttgcataaaagtcacttggtcagcagttgttgaagctgaacttggaatctaggtctatctgaccttaactatgttccttccacagagccacgttcattccatagaggaacccaccacctataaaaccagaaaagagacaaagccagaagtgcagggtggatttcttaacacaagctcactgcgacctctactcctcatcacgctgacactaagcttaaacccagacccttctacagttttgtctacaaagcacaatttgcccaaagcctttacaaacaccaacagcctttctttcagatatggcagcagggtcacatcttacacggccctgaccacattttgtctcctctgccatccccatctctctgactcagtcttcgcttgcagccataaaaaaggatgagttcatgtcctttgtagggacatggatgaagctggaaaccatcattctcagcaaactatcgcaaggacaaagaaaccaatcactgcatgttctcactcacaggtgggaattgaacaatgagaacacatggacacaggaaggggaacatcacacaccagggcctgtcgtggggtggggggagggggggggagggataggattaggaggtacatctaatgtaaatgatgagttaatgggtgcagcacaccaacatggctcatgtatacatatgtaacaaacctgcacgttgtgcacatgtaccctagaacttaaagaacaataataataataataataataataatgggtcttgtacatctaatttgccctacaaatgttaaaacagcaaacccacatccccttcctcttctcatgtgctgtgagggatgacctccaggctctcagataccaagattgtacaagacctaacccagagaattactcaagacactttctacgtaagaagaattgtggtgctagctctcctcatagaaaaatgttttctgtctcttgttgaaattgacagcaaacacaaaaacacagaactatttgggagaacagaggacagtgatacactagggaagtaaaacacaccccttccccttgcattggtttcctgttgctgccgtaacaaattaccacaaccttactgctccccataacacaagtgtattatcttacatttctggaggtcagaagtctcaatgaagtaaaatcaaggagtaatagggctctattcattctaggcttcaagagagagaatccaatatcgagcattccatctttctgatgttcccacattcctagcagcatggccccttcctccatcactccagtttccctgtccgttgtcccaggtcctctctggctgttaccttcctccctccctattataaggacccttgtgattatgatggtctcacccagatcattcaggatactctcctgacccccaaattctcaaccatgtctgccaagttatttttgacatattcataagtaatgatcatagattccagatattaggacaatgatgtctttagtgggtgtattattcattccacaaacaaccctcatcatccacacaatggtcttcccctaaggtagaataaaaatatcacaaggcagatttacgaggcgatcgacctagaaaaaacctgagaatctaggactgtctgatgtgtggatgtcaaatcctgggagattctgagtctctgctctatgtggactctatgttgtgtagccatttgtggaaggcttctgtgattttgtgacctagagaaaatgaatctctgctaaaatcaaatctaagaaagattggcaaagggaatttaaagatttcctaaatttttggaatttccctatgcattaaagcatgagaagtggcaataattcaaaccaacgatgccctccaagaatgaggatttttccaatgcattaggttgggtcccctcagtgagaaggatgccaaagattcgcatgcaggcagtatatttacaaagtgcgggaaacaagcaaatgagcaagggaggggaggagggaaagggaaagtgaaaggtgcctcagaaggagccacctctgaggatgacgacagctcaagcccacatagaaacacaggaaaaatgcctctgttattccacctgagaggtgagggagctgcgggatgtgtacacctcccttgtcatcactgattgacagccgtcctaggggatgctaattccaggccatgaggtctgcctcatttgcagcctgagctgcttccccaggttcagacagagcagtgaaggggagaaagggccatagagagtcagctgaagtataatgactagaatccccaaggcgtagtaacaatgactgctaaaattatgcacaaagaaaaagcgcatttgaatccagagatgtatctctctgaatctggatatatggatcctggcagcctgttcagtagccatttcccagaaatccagttctctggaaaagcagcaggaggtttgtgcacaggctgcactaccttggtctggccactggtagtcgtgcatgagaactactccctggagtatttctcagtccactgacactgatgtaattggctccacttcccctgctgttgagccaggccgacacgccctgggcaaaggcatctgtgtgaagtattgaggttcaaatcagtgcttaagatatgtttggaggcaaaatactttttcatctacatgggcagtgtcttggcagaagatggagattctctctaaatggatgtgagacagggtggctggcatctgggtcaggatgatgccctggtgcatggcaagaacatgcattgggcagcagctgtcctcgctaagcagagaggttcactgacctggcttttcccccctcacctgctctccagaaagccagactctagggcagatgctcctgagaccccaggaacaggctggtggggagcgcagctcagagcattactcaggggatgtggcctttgtcatcctactttgaaacaattgattatttgagcctagattgatagagggcttcaagttgattttaatcctggctcctatagtccgcgagtgaaacagagattttgaaataatgagacctggtattactagtcagctctccatgctggagaaacataagaaattataccaaaggcaggaaaggggatagaatatggggatcatcacgccaagaataaggtgcagcccatttagcccctaggtcttaaagagacccatagctctggataatggcagatctatgcgtgacacattatcatctttgtgcatcttcagagaattgtttttccttttactcctaggaacaatgtcttaagtttgttagtaaattctattgaatttattaaagatgcttctgataaattctttttatattcatttcaaaaaagaagcaatttcacactgacagagacattgttattatagcactaaatacttttacactcatcaaattcctttgagactaactgaaatttctgacagccccacactctataactttattgtaaattttctgccaaaaatgatgctttcctatacactcttaatacaagtataaatatattatttaatctagtcttaggttgatttaaaattttgaaaattcactccaaaaatatgttctgtaaccatatggccaccaatgagaagtgtactctttcaaggtaaatctgtgctgccctggtctgacctgggactctggggatactgcgcccgtgtgctgagttactgagatgagccagccctgcagctgtgctcagcctgccccatcccctgctgatttgcctgttcctagagcacagccccctgccctgaagacttcttataggctggccacacccggtgcaggagtcagccccagtcaggacacagcacggacgtgagggcccccactcagctcctggggctcctggggctcctggggctctggctgccaggtaaggaaggagaacactaggattatactcggtcagtgtgctcagtactgtctggaacttcagggaagtcctctgataacatgattaattgcaagaatatctgtttttatgtttctaacttcaggtgtcagatgtgacatccagatgacccagtctccatcctccctgtctgcatctgtaggaggcagagtcaccatcacttgccgggcgagtcagggcattagcaataatttaaattggtatcagcagaaaccaaggaaaactcctaagctcctgatctatgctgcatccagtctgcaaagtgggattccctctcggttcagtgacagtggatctgggacagattacactctcaccatcagcagcctgcagcctgaagattttgcaacctattactgtcaacagagtgacagtaaccctcccacagtgttacaagtcataacataaaccccaaggaagcagatgtgtgaggctgggctgccccaatgctccttctggtgcctctatctgctgagggaagttctcaaactcagtcaggtttggaaagtcatcgggagattttcctagaggaggccagggaggttcctctgaaccctaagcctctttcgccctcatccccagcagaaaagacgtgacaatgcctgtcctgactgaataaagaagagagataagtccagctgaggagtctgtgttatgggataatcggaatttgtacagcaaaagagaagctattctcagtatttcaaggagaaattattcaagttgaataaattagagtctaaaccacagtctttccgaagcctatggagtgttattcatgaagcaggtactagacacaggggattctcaggtgctacttcagaagccaggatgcacctgcccctggtggtatgtgctgaacaccgtgtgatgatcctcagtcctgtctgggaagcccagggctgggggtgctgatgctctcagctgcctgcagcacatctccaggtgattctccagtccacacctaactgcatgtgttttacttcaggtgtcagtgtacatgaatccaccactctgacttcccaatctcatgacagtaattagttgtaacttattgtaacctcatggagcaactctaaagaaaccatagagagaaaaggagttttggaaaatgtgctcccggaagtgatagtaatgatggggaattgacagctgacggggaagtaaggtgactctttccacaaggctcaacattttgccagttatgaattgttgcaaaatacatttgaatgtgctttcaagtattaccagtttggggtcatagctgaaaaactttattaagtcacagataaaatgggaaaatcaggaatattttatattgtatgaaatatacaataacactgtgtgtgatggctcaggtctgtaatcctgtgatagttaatactgattgtcaacttgattacattgaaggatgtaagcattgctcctgggtgtgtctgtgagggtgttgccaaaggagattaatatttgagtcagtagtctggggaaggcagaccccctacttaatctatgggcaccatttaatcagctgccagtgaatataaagcaggcagaaaaaagtgaaaaattgagtctggcccagcctcccagcctacatctctctcccgtgctggatgcttcctacccttgaacatcggactccaagttctttagttttgaggctcgagctagctctccttactcctcactcctcatgcctgcagacagcctactgtgggaccttgtgatcctgtaagttaatatgtaataaacccatatatatatatatatattgaacttattagttctgtccctctagagaaccctcattaatacagattttggtaccaggaatggttctgcaggatcagaatattaaggctggagttcttttgttggttttggggtttctggatttggctgctaaatatgattagatcccaaaatgctaaggactctacttttaatagtgtagagaatattgacagttcttggcatgaaaggtttaaagagctatgcaaaacaaattcatttgacactaatgaatcatcgctcatgagaggcaaggagtttagtgactctgtacctaatacccttgacaaacaccttgcaaaatagatttgtgaggacagcacctgcatctttgaagagccctgtaaaggctcttctctgtatgtcagatctaatggtgagaactgcagtcactcagttacaaaagttaaatacaatttggaataattggatcctgaagtggcaggggccaagtggtagcactcaaccctcaaaggcacggtgggcgtagctaccgtaatgggcagaaaagacaaagcagcaatctgaacagtctgactcacgtagagctctggcattggctaactaatcacagtgttcctggaagtgaaactgacaggaagactaatgcattcctacttaatttatgtaaggaggaaacttaaggtcaaacagataaaagactaactggaatcataaaaacagagattcatggcccctcaatcaatttccagccttgagccagtttacagacccagaaccccttgaatgaaggggaggctgggtccccctgaggtgtccatggcagataggaatgctgctttgaggctttggcaagcctccataggtgaatcatggtggaggcctctagtattttgcagcaaggaccggtcatcttctccagttaactactctccttttgagagacagctcttgtcctatactgggcttttgtggaaactgaacatttgactatgagtcaacaagtcaccatgcgacctgaactgcctatcgtgaactgggtgctttctgactcatgtagccataaagtgggtcatgcacagcagcattccatcatcaaatggaaatggtgtataagtgattgggctcaagcaggtcctggggggcacaagtaagttacatgaggaagtggctcaaatgcccacggtctctactcttgccaccctgccttctctcccatggcctgcactgatgacctcatggggacttgcctttgagcagttgacacaggaagggaggactagggcctggttcacagatggttctccacaataggcaggtactgcccaaaagtggacagctgaagcactacagcccctttctaggacatccctgaaggacagtggtgaaggacaatcttcccagtgggcagaacattgagcagtgcacctgattgtgcactttgcatggaaggagaaatttccagatgtgcggttatatactgattcatgggctgtagccaatggtttggctggatggtcagggacttggaagaagcatgattggaaaattggtgacaaagaaacttggagaaagagtatgtagatggacctctctgagtggtcaaaaactgaagatatttgtaccctgtgtgagtgttgaccaacaagtgacttcagcagaggaggattttgataatcaagtggataagatgacccgttctgtggataccactcagcctctttcctcagacacccctgtcattgtccaataagcccatgaacatagtggccatggtggcagggatggaggttatgcatggattcagcaatgtggacttccactcaccaaggctgaactgtctgtggccactgctgagtgcccaatttgccagcagcagcagcagagactaacagtgaaccctttgtatggcatcatttcctggggtgatcgaccagctacccggtagcaggttgatcatattggaactcttccaccatggaaaggagagaggtttgtcctcattggaacaggcacttactcaggatatgggtttgcctacctgcatgcaatgcttctgccaagactaccatttatggactcaaggaatgccttatccactatcacggtattccacacagcattacctttgaccaagcactcactttacaggtaaagaagtgaggcagtgggctcatgctcacggaattcactggtcttaccatattccccatcttcctgaagcagctggattgatagaatggtgggacggccttttgaggtcgcgattacaacatcaactaggttgcaatactttgccgggccggggcaccatactccagaagaccatgtgtgctctgaatcagcgcccaatgtatggtattgtttctcccatagccaggattcacagatccaggattcaaggggtggatgtgaaagtggaaccactcactatgatgcactagcaaaatgtttgctttctgttcccacgacattaggttctgctttactagtcatcttaactccagagggaagaacgctgctaccaggagacacaataacaattccattaaactggaagttaagatggccacttggatgctttggggtcctcctacctttaagtcaacaagctaagaatggagttacagtgttggtggcagtgattgacccagactatcaagatgaagtcagtccgctactccacaatggaagtgaggaagagtatgcatggaatataggagatccattagggcgtctcttggtattatcatgcactctgattaaggtaaatgggaaactatacccaatccaggtaggactacaaacggtccagatcctctccgggtcacgaccttctgaggtgcttgctgaaggcaaagggaatacagaatgaatagtggaagaaagtagttatcaataccagctacaaacacctgaccagctgcagaaatgaggactggaactatcatgagtatttccttcttttgttagaaacatgtttgtgcatgtatgcacttgtactaagaaaatatcttcatttcatttcccttttctttatcaggtgacatagatttgctgacctcatatcagcatttaagtattgtttactttatgtaagagtatttgggttggggatgggtgcatttccagttgtaggaaggatagtttattatgttaggggtaattatgaccttactattgtctgtattttaagattatgtatgatctcaggagatgtgtgtgggttcaagttcacaaggggtgggcttgtgatggttaataacgagtgtcaacttgattggattgaaggatgtaaagtattcatcctgggtgtgtctgtgagggtgttgccaaaaaaaattaacatgtgagtcagtgggctgggaaaggcagacccacccttaatctttgtgggcacaatccaatcagctgccaacccagccatactataagcaggcagaaaaatgtgaaaagagacgggcctcacctcccagcctacatctttctcccatgctggatgcttcttgccctcgaacatggactccaagttcttcagttttggaactctggctggctctttttgctcctcatccagcagatggcctattgtgagacttggtgattgtgtgagttaatacttaataaacttcctgtattagccagtgacatctagagggacagaactaacaggatatatacatatatatatacatacgcacacacatacatatatatgcacacacacacacacatatatatatttatttataaaggggagtttattaacttacaggatcataagttacacaatgggctgtctgcaaactgatgagaaaggagagccatggggtccaatgtttgagggcaggaagaaaccagcatgggagaaagatgtaggctgggaagctaggccagtctctccttttcaaatttttctgcctgctttatatttgctggcagcagattagattgtgcccaccagattaagggtgggtctgccttccccagcccactgactcaaatgttaatctcttttggcaacactctcacagacacaccctggatcaatacttcatatccctcaatcctatcaagttgacactcattattaaccatctcactccccttcatatatatatgtatatagtcctttaattctgtcagtctagagaaccctgactaatacatctacacttctgatgatctatttcttttattttaggtcatttatttcccctgggttgcctacactcgcttcttcccactcccctatgaaggacaatataagcctctggacctcactaggtcagggcatgtccctgcttgcactatccatgacacttttctcttttactctttagcaatgagggaatgtcatccttacccagatgccagccacctgtctcacatccaggacagagagtctccatctcctctccagcaaatacctatgtatgtgggcatggtggcatgcccctgtgatcccagctactccataggcttagaggggagaatcacttgtgcttgagaattcaaggttgcaaggagccatgatcacaccactgcacttcatgctgggcaactgagtgagaccctgtgatttttcccctacattttacagaatttttttttgcctctttcttctattaatttatgttttgtccattcattttctgcaaaccttcagagggcaaataggaagtttccctttttaacgtggtggctcacgcctgtaatcccagcactttgggaggccgaggtgagcagatcacctgaggttgggagttcgagactagcctgaccaacatagagaaaccccgcctccactaaaaaaaatacaaaattagcagggtgtggtggtgtgcacctgtgatcccagctactcaggaggctgaggcaagagaattgcttggacctgggaggcgaaggttgcagtgagcccagattgtgccactacactccagcctgggtgacaagagcgaaactccatctcaaaaaaaaaaaagaaacaaaaacaaacaaagaaaaaaacacctactgcctcactgaattaaaggtgtgttcagcagtttctttgttatttcgaagagtgtcatctgcttcagcagggtcagtttttaatgtatttgttttgtttcttttttctctgtctggtgttgttttctattttattataattttttaaatttgagggatgaggttttcatagcactgaatatcaaacaatgaatccgcatgaatgattcacctaatttccttggttttagtcctctatacaggttttatatagcaaaagaaccatttaaagacttgggttacaaatgtattttattttacctctggcatgccttgggctgagaaagcattatatggtgacacagtatttgtaacattctcatagccatctggcggtggttcaaggtatgacattttgaaaatctagcaagaattaaaatatgtcaagttagagataaaaattccagattattattaagatataattcattttgccccaagtatatacttcagattaagcatcctggaactaggttctataattaaatagataaattacactgacaacaatgagaaagagccttatcattattattgtcttcctaataatagaaacttttataaatgcatgcaatcccaggtaaccaaaagtttccttataaagtgtaacagcagagcttcaaaggtggcatttggcaagcctctttttttgactatgccttttcagcttcctttgtgggctccttttctttcatctttatttaaataatatttccctatgttttatccccagcccattgcttgcctctgtactgcctccctgtgagacttcattaagtatcagaattttaccaatagctcatatgcttatgatgcttaccttttcagattcgtatatttaaatgttttgtgattatttcatcctggatgtccaaactcaacatgttaaaattcaaatttatcatctctcaccccgggcctgcttttggtctgcatttcctacctctattaatagcttcagttattagccaccgacaccagacagtctcggagtcatcctgaactctatcttcccctccttccccaagtcaatcactaatcaagtcctgctaatacatttccttactatttctgaaatccatccctcttcctcattcctactaacatcctaatttaaaactttattatcttttacctggactattgtcttaagacaacaactttaacccgttgcttagcctaggtgtaatccacagaggatcttgtctgtctaagatgcccctctagccacatccttcccctgctcagatcttgtcattggctcccatgaactgaagttgaagtttaagctccttaggacagcatacacgcccttctatgatctgttcccagaacatatttactggtttatctcatatcatggcccactttgtattttacacttttgaaatacagaaaatcattacattctcccaataatactaagctagtatatgcctaaaagcctttgtcaatattttgtcttttgttgagaattctcttagcttattttgtcacgtggttaactccttatgtcctttcacgactcacatgtcaagaattcaggaaaccttctctaactcccaggctgggctgagtgacccttttctgggtaaataatgaactctaatcatactcttcatagcacttaccatactaatttgaagtctgaagtattccattttctgcctcagtttacttaggcaaaggaaccatgtcctagtctcattctggcctcaggacttcagcctgggcgacagtgggagactgtgtgtcaaaaaaaaaaaaaaattgccaatgattgaagcctaatactgaagattctggtttattaataattagtctgttgctgggtgttaattgagctccccaagtgattactcatgtaggacttcaaaacgataatttagaaccttgtgactaaaaatctgggcaaaaataagcagcatcagtatcacctgggagcagcttcaggtctcactttagatttactctgaatctaaatattatatttttattaaaaaaattaagaacagatgacaagcttcaactacatctaaattctttagatttactttcaaagaatcaacattttgacacaataccaaagtgaactaaattcgcttttttttttttttttttgagacagagtcttgctctgttgcccaggctggagcgcagtggtgcaatctcggctcactgcaacttccacctctccagttcaagcgattatcttgcctcggcctccaaagtagctgggattacaggcacatgccatcatgcccggctaatttttgtatttttagtagagacagggtttcacaatgttgggtcagctggtctcgaactcctgacctcaagtgatctgtctgcctcagccttccaaaggctgagattatagacatgggccaccatgcccagcctaaatttgctttaatttggagaagtactggtctagaaaacacaaattccaaggagactcaggttcttaagttgatttcttgagtacaagttcttcaaatgcattctccaagattaatttttttttttactttttaaattgacaaagattatacatattcatggctatatggggatgtttcagtacatgtagatggtgatcagatcagggtaattagcatatctatcatctcaaacatttattatttctttgtgttgggaacattcaaactactcctaggtattttaaactacataatatagtattgttaactatagtcatctacagtactatagaacactagaacttattactcctacctagctgtaattttgtatccattaacaaatctcttaccattcctcctttctccctacccttttcagcctgcagtatcctctgttctactttttacttctatgagatcaacttttctttagcttctgcgtgagtgagaacatgtggtgttgaaatttctattcctggcttattttgcttaacataatatcctccagttccatccatgttgctgagaatgacagggttttatttattcttttttatggctaaatagcattccttggtgtatatataccgtattttaaaaatccattcatctgttgttggaaatctaggttgattccatatcttggctattgtgaacactgttgcaataaacatggggatgcagatgtctctgtaatataatgcttttctttcctttggataaattcccagtagtgggattgcttgaggtgtttcaatactgttctccatactggctgctctaatttacattcctaccaacagtgcataagagttcctttttctccagctactcaggaggctgagggaggagaactatttgaaccctagaagcagagggagccagattacaccaccactgcactccagcctggacggagagtgagattctgtcaaaaaaaaaagtcccttttcttcacgtctttgtcagcatttgttatttttgtctcttctataatagccatcctaactgaagtaagatgatgcctcactgtggctttgattagcatttccttgctgattagtggtgttgaacattttttcatatatttgttggtcatttgtatgtcttcttttgagaaatgtctgttcagagcatttgtttatatttaattagattgttgtgcttctttgctgttgatatgtttgaattccttgtatattcttgatattaatttcctgccagatgagtttatactttctcccattctgtaagttgtcttttcactcactttcttatttcctttgctgtgcagaagatttttagcttgatgtgatcctatttgtttattttttcttttgttgcctgtgcttttgatgccttattcataaaatattttcccagagcaatgtcctgaaggatctcccctatgttttcttctagtagctttaccattttgggtcttatatttgggtatttgagatactttgagttgatctttgtatagggtgagaggcagaggtctagtttcattcttctgcatatggatatccagtttttccagcaccatttattgaagagactatcctttccccaatgagtgttcttggcatctttgtaaaaaatccgttggctgagatatgtggattttctgggttctttattctattccataggtctatgtgtctgtttttatgccaataccatgatgttttggttactacagttttgtagtgtattctgaggtctggtagcatgatacatccagctttgttctttttgcttaggatggctttggctattcaggatactttttgattccataaaatctctttggatttttttttaattttgtgaagaatgttcataggtattttgatagagattgcattgaatctgtaggttgcttttgagtagtactgtcactttaacaacattcatatttctgatccatgagtatgaatgtcttttcatttgtttgtatcctcttcaatttctttcattagtgttttgtagttttcattttacctccttagttacatttatgtctgggttttttttttttggtaactattgtaaatgggtttgccttcttaatttctttttcagcaagtttgttgttcatatataaaaatgcaaccaatcttcatgtattagttttgtgtcttgcaacttcactgaatttgtttgttctaaaagttttctggtagtcttcaggttttcctatatataagatcatgtcatctgcaaataggaacaatttgatgtcctcctttccgatttgaatgccctttatttctttctcttgtctaattactcttgataggacttcacatttatatactttgaatatttaaaatgtttacataaatgtcagaatcaactttcatttttcatagaaaaagaagatcctacttgttttgtagttttaatattaatcaattattattatctgagacaaattattaacaaaccatctattaaaatatttcaccacaaataaattccataaggaaaatatctacaactgtttttatgaaagaaaaaaaggcttctctacagttgcttaggcctggtgccatggcacacacctataaatcccagcgctgtgggaggccatggcaagaggatcctttgagcccaggagtttgagaccagcatggacaacaaagtgagacctcatctctacaaaaaataaaaaagaaattagctggccatggtggtgcgtgcctgtggtcctagctactcgagaggctgaggaaggaggatcacttgagccagggaggtggaggtttcactgaaccatattcacaccactccactccagcctgggcaacagagctagaccttgtctcaaaaaattaagttagttaaattaaacataaagttgcattgtatttaagaaattgggaaagcagaaaatgcttctgtttttcttttgagttgaacaatgagaacacatggacacagggaggggaacatcacataccggggcttgtcaggggggtgggaggctaggggagtgatagcattaggagaaatacctaatgtagatgatgggttgacgggtgcagtaaaccaccatggcatgtgtatacctatgtaacaaacctccacgttctgtacatgtatctcagaacttaaaatgtaataataacaataataaaaacctcaaaaaaaggaaatgcttcttcttagaacagattacataccctcattgctttttataatagcctgtaataacagaatatccacaaggtggcagtaatatatcagtttcatcctctgaaattaaaacttttgcctattcagtaatacaatggatcttttgaactcactctaacacgtagaatacagcaatttgacttaataattagcctttaaatttatagtcttgtattatcactttagtagtttgaattattttgtattttaatatatttaaatgaattagtcctatagaaattgactaatttgacatgtgaaggtgtttttattctattttcagaagtttagctttaaaaaaatttctaaacttcgatatctggtgagtgtcaatgtttttatcttattaaaagctgacagaccacactatattcaactgatttttttttaacaaggatgcaaaatcagtttaaaggaaggatatctttttcaacaaatggtgctacagcaattggacattcacaggtacaaaaactaagactgacctaaatttatactttatataaaatttagctcacataaatcacaggcttaaatgtaaaatgtaatattataaaacttaaagttgtgtatggtagctcgtgcctgtaatcccagctactactcaagtggctgaggtggaagcatcacttcaatccagcagttagtggctgcagtgagcaatgatggcaccactgcactacagcttgggcgaaacctcgtctcaaaaataattaataaataaataaattcactaaactttttaaaatagaagaaaactcttgagaccttgggctaggcaaagaatttttaggcttgatattaaaaacaaaatctacaaaaggaaaaagtgataaaactggacttcattagaataaataaacactttttttttttttttttttttttttttttacttagaaagaccctgtaaagaggttgaaaaaatgaattacagactgggagaaataatttgcataccatatatctgacaaagaacttacatctagcatatgtaaaaaattctcaaaactcaatggtaataagataccaattagaaaataggcatatgtgacctctctgtattataacttaaacctcatgtgactacaattatttcaaatgaaataaacaaaacagtaatgcctgtttctggcatataaaataatcagagaacatagaattgtacgaagttaaattattgggccatttacttaatttaaatatttttaaatgcgtgtacccattttgcttgaaggtgtgtgcaagtatgcttgtattttttttaacgataatatggtcacatgagcattaaatttattttttaaaagtttatagttaccccacacaagttcttattgattccctcattcttaacacctgcatagtatttcattttataattaatggattgtaggtttattcttttaaaatcacttgtgttgttctcatttttttttttcactaaaaagtgttgcaatgcacaaaactaaaaatataaggagggtcttttctggatctctgttgaaaaactttgaataaaaattacaagttcaaatcacatgcaaaataaacattttaattaatcgggcttttatgcaagatgttagtagcagtagcagcacagttttattaagatccctgaatctctcacaaaaactgactgagcaactgggataacaaggtattaactacgacaaaacaatgtaacagggtgtcatcatggacgttttgtgaggttaaaccacagggacccaggggaatcaccaatttttttggaagaaggaaaggaaaggaaaaaaatgtttaatggccctgggaactggaaaacctagaaatacaagtgctaacatctgtgttcctaaattcagagattcttactaggcaaaaagaactcagcagattaatctgagaacagcagctgaggctggcagaaggcttcctgggcctcaactcatagctgagagtgagggtggcaaaaagcagtgctgtgagtggtctgtttcctatgaaccctacaaattaaccacccccaaaacaaagccctgtcctaaggagaaactgcaggaagtcaattataaattgagttgggaagcacactgaggctcaagaaaagggaagctccaggttaagatgcaagagaagaagggaaaaggcagttttctgcaagttcaagcacaaataatttctttaccttctagttctggaaataccaggtgctgtgtatgtaaagcaggaattttggttgaatattatataattttctgacccactgttactaatccagtttcccctgtactcagatcttccatactacagacagacctgacagatgctcagcaaatagtagctaatattttctaggaaactatgtgctaaacgagttttcttaaatttctacctccaggtctgtaagttgatttgaagcattaccagtttctggttctgcacaggttgttgagcgcaggacttctctcctccagtggaaagtccacctgctcacaatcaaccatcctttcctgcagccttggagacactactcagtgtagcatgcctcccagtctagaataggcacactcatcatcagtctctctcattttctgtcttatctccattccatctacatacagtttttgttttcaccaatgtttttaaataaacaattgtacaagcacgacgacaacagaaaccttccttcccccagtgttgtagtgagcaaggaatatatttaacttcaaataaaagacaagaacaaatgctggataaagctgacagaaagaaatgcaactgtaggtgctctggcaatatagaaatgatacaactaagaaaaatggaagaaaaggaaagagaaagtattcctcagaatgattttactgactgctcatctgtaatgcctgggagtcaaaggatattgtttatagaaatgtaagcatacttaatggcaccaggggaaacaaagttaatatgattaaatcaaattgtgggatgaaaaatcacatagggaggacaagaaagagaatacagctaataccattgttcttagtttagagacattagctactgtctaaagaaagagatgattttatgaaattacataaggtagccatcagaataaaagtttaactcttccaaatatcacaacatcaaaacaaaagcaataaaacaagacagcaaaagacagatatgtgcatataaatcatagcataatatactgtaatcaaaatataaccaaacacaatttatcattaaaagtaagtgggcttgactcttattagaggaaaaaatattgtcagattaaatcaaaaagcaaatctcaattctatgctggatataagataaagtgttacagaaagtttagaaataaaagtataggcaatgaataaaaggatcttctcttcatgcgttaggagtataaaacagtaagtaaacacatcatatgttttctgtttttacacttaaatggctggagatgttacaccactagtatgaatttacttcagatatataaaggatacacttttatgtggttagaaacagcaatgataatagttaaggtgaaaataacatctgcattgaggctaggaagaaagagccattgttgggtacatagtgatcgtattaccatggagcaatctgttcccaactgaaatgtccttgaccttctactgaaatcatgtaagattctgcaaaagtagtgtttacttcccacaaatcagccatttgtgggaatggctgctattgttgtccacacggaatgagcatcagacctatatttagctgttgtttcattaagagtcgtatttggccctttccagaggccgttatttcaattacattttggagaattagtctatttccagacaaataatttttccagaactttgatccatatgaaatgtccctttggtagggatccagggattgagtttatttttaattactgtagcatcctggtcaggttgagaaacagattacctttatatttccctggcatgtaagcagggctagatttagcgtgagaatgcttgaaagtttatagttttttagaaattttatttactgtgtgtctctttatcaaaataaaattaatgctgaaaagctatattaaatgaattattttgagatggtctcttcccccttcttccagtgagaggatatccacagatatgtcaggagcttgctttacctagaaatgtgttgagggccacaggtttgggttcacctaggaatgtttagggacacctccccaagttgttgttgaagagtggggtaaatgtaagatagaattaggctcacggaggccagatgagagcatcatatcaccccagaaacatagcatatacctaggagatctgttctcagtatcaaagtcttaagcactgtaagattgcctatagaccaagacaacaactatatatatatatagttaataaaatcagttaatatataaacatatatttattaacttatttttatttttatcttcagacagcatcttgctctgtcacctaggctggagtgcagtagtgcaattaaggctcactgcagccttgacctctggggctgaagctatcctcctgcctcagtctcctaaagtgctaggatgagaggtgtgagtcaccttgccaggcccagggcaataactatgcaatgtttatataatttggagcaaaaaatatttgaaatatgtgtgcattgctttttaaccttttctactgatttactttattaaatactgaatagaaacaatatatttataaaatatttattttatatatataataagcacataatgaacacctgtgtctccagtcttggtttaagaaattaagccaaaagtaatcataagtgcttatgattacttttgaagtcacctgtacaacttttgctgactacatccccttcttcaacactctaacgatggccactgtgagcactgtgtatattgaattgtgttgtattttaataccgtgtgcactactttgttttcctagctgtatgctattgcatttagtgagcataatgaattatatcagtataattcacttttgtcatttcattgtttcagctcttctgtactaattattgccaatatatttctactggcataaaaacagacacataggacagtggaacagaatagagatcgcagacaaatctacacatttacaaacaattcatctctgacaaaggcatcaagaacatacactgggaaaacaacagtcttttcaataaatgatcctgggaaaactgaataaccatatgcagaaggataaaattaatcccatctcaccatacacaaaaatcaaatcaaataaaaatggattaaagacttgaatctgagacctgaaactatgaagctagtaaaaaaaaaaaaaaataggaaaggccgggcgcggtggctcttgtctgtaatctgagcactttgggtggccaaggcgggcggatcacaaggtcaggagatcgagaccaccctggctaacacggtgaatctccgtctctactaaaaatacaaaaaacaaaaaaaaaattagcggggcatgatggtgggcgcctgtagtcccagctactcgggaggctgaggcaggagaatggcgtgaaaaaaaaaaaaagaaagaaagcaagcataggagaaatgctccaggacattagtctgggcaaagatttttttgcgtaagacctcggaagcacaggcagcaaaagcaaaaatagacaatgggattatatcaaactaaaaagcctcaagcaaaggaaacaatcaacaaagtgaagagccaagcacagaatgggacaaaatattttcaaactatctatctgacaaaggattaacaagtagaatatataaggagctcaaacaactcaataataaacaaacaaaaaatctgattgaaaaatgggctactgaagaggctgaggtaggaggatttctttttttttttttttttttttttttttttttttttaatgagatggagtctcgctgtcgcccaggttggagtgcagtggcgtgatctcggctcactgcaggctctgctcccccggggttcacgccattctcctgcctcagcctcctgagtagctgggactacaggcgcccggcaccaatcccggctgattttttgtatttttagtagagatggggtttcaccatgttagccaggatggtctcgatctcctgacctcgtgatccgcccacctctgcctcccaaattgctgggaatacaggcgtgagccaccgcgcccggtcaggaggatttcttaatcccaggagtttgaggttacagtgagctatgattatgctactgccctttagcttgggtgacaaagcaagaccttacttctcaaaaaaaatagttaaaaatatataaataaatacaatttaaaaatgggctaaagatctgaacagatattttctcaaaagaagacaaacaaatggccaataggaagacaaaaaatattcagtatcactaatcgtcaaagaaatgcaaatcaaaatcacaatgcaatatcatctcaccttggttgaaatgacttgtttcaaaaagacaggcaataacagatgctggcaaggatgtggagaaagggaaatactagtacactgttggtgggaatccacattaataaagccactatggagaatagtatggaggttcctcaaaaaagtaaaaatagaactaccatgtggtccagcaatttctttactggatgtatatccaaaataaaggaaattaatgtatcaaagacatatctacatgccgatgtgtactgcagcactattcacaatagacaaaatatggaatcaacgtaagtgctcatcaacaaatgaatagattttaaaagtcatatatatacataatgcaatactactcagaaacaaagaagaatgaaattctgtcattcacagcaacataggtggcactggccatttggtttaacgtaatgaacataggccattatgttaagtggaatgagccaagcacagaaaggcaaataccacatgttgtcactcatatgtgggcagtaaaaaagtggatctcatgaagatagaaagtaaattggtggttgctagaggccagcaaggggagtgggaagaggagattaagagaagaaaatataaatgtatttatcaccactaaactgtcctctaaaaatgtacagatggtaaattatatatatatatattttaactcaataaaaagttaaaaaaattctgctgtgtgtttatagggcacatgtacaagactttctctagggttgtatcagttttctattcctgctgtaacaatttaccacaaattcagtggcttaaaagaacacatttttgtaagatttgagtcagttttaaaaaacacacacagacttattgtcttagaattgttttggttggaaatctggcatggctctcactgaactaacatcaagatgttggcaggctgcatttctttctgaaggctctaaaagagcatctgggttgttggcagaattcagttccttgtggttgtagatcctcagtttcttcctggttgtaaactttgggtcattcccagcttctaaaggtcactggcttttcttggcttgtggccccctaccactgttttaaaagccagtaatagcaggccacatctttctcatactgccatctgtctgaatctcagcatccagaaaatattctctgctctcaaggaattatgagattagactggctcaccaaggtaattcaaggtaatttccccatttcaatgcccttaatggtaatcacatctgccaagtctctttgaacatgctaacttacgttagcatgttcaccttatctgaagactgggatgtggctgtctttggtggggggcaattattctgcctaacccaaagatacacaacttgcagatatacaactagttcatggagatgaaacattttcaaatctacaagaaaatgttttctaaaatgagcattgcatattagactttcacgagcactgtatcagacttatatttacttcataatattgccaatactgatatcagatatttaattttctagccagttcaggataatgtgaattgtgaataatatatttgttcatccagtcaacaaacattttttatcagataccaccgatatgctggacagtgtcatggatcctaaaaatatagctgttattattatttttttaaacaaaatccccactgtgataaagcttttattctttgggacaggcagacagtaatccagataaataaatgcaagggaaaattgggggaaaaattggaatggagagctcagaatctggccccagagaagggcagagggaaaggggacccagttcagaatctcggtgcgtccacaccaaacaattccatgagggctgaagagacagagctgaaaggcttgtctgacatcacaaaagacagaaaagtgagccccattttcatctctatcctgacaatgttcctggcttgatttcctccttccagcagacacaagaatcagggagcgcaccctgatggtaacatttttttcaggggcctattttggggatcctggtgagaacctgagtccgtcactgtccacggcagcccagcatggtccccagtgcgtggtccaaggccaagattctctacctccatcctggaggcagaagaaatgtctgggggaaaatgagaggttttaggtggttggcactgggtgagaccaaggagaaattttaaagctgtgtgtcctggggccgggggtggtggctcacgcctgtaatcccagcactttgagaggccgaggcgggcagatcacgaggtcaggacattgagaccatcctggctaacggtgaaaccccgtctctactaaaaatacaaaaaattagccgggcttggtagcgggcgcctgtagtcccagctattcgggagactgaggcaggagaatggcgtgaaccgggaggcgcagcttgcagtgaactaagatcgcgccactgcactccagcctgggtgacagaaagagactccttctcaaaaaaataaaaataaaataaaaataaaaaatagaaaaagctgtgtgtcctttgtttcttcatattttgcagatttttgatgtcaaaatattttcatagtcaaaagagtgttaataaagaatgacttctctgttataaaaaccctaatagtgaatgtatttaccaagaaattagattctatctttggttttttgttttttgccccgtagtttttaaaaaaatagttttattgtgtggatattctacagttagtgtatctattcacctcttgatggacatttggtttgcttccagttgtttttgctatttcaaataaagttgctacgaatgtttgtccaatcgtttggacatacactttcatttgtcttgggcaaataagcaggatttgaatgactaggtggtgtgatatgtttaacttttttttttttttttttttttttttgagacggagtctcgctctgtcgcccaggctggagtgcagtggtgcatcgcggctcactgcaagctccacctcccgggttcacgccattctcctgcctcagcttctggagtagctgggattacaggtgctcgccaccacgcccggctaattttttgtatgtttagtagatatggggtttcgccgtgttagctaggatggtctcgatttcctgacctcgtgatccgcccgccttggcctcccaaagtgctgggattacaggcgtgagccaccgctcccagccagtttaacttttaaagaaactgacaaagtggctgtatttccagcagcagtatatgagcattcctgttcctttgtgttctcaccaatgtttagtatggtcagtcttttaaattttagctattctaataggcaagtaacagtatctcattgtggttttaatttacatttccctaatgatgaatgatgtgcttatgtatcgtccatctgtattctatggtgaaatgtctgttcagatctctacatttgtgttagactatttgttttcctattattgagtcctgagagttctttgcatattttggataacaaatgtatcttcaccagatatagcttttgtaaatttttactcccagtctgtgatttgtctttttattctctcgatagtgtttttcttttttcttttttttttttttttgacagagtctggctctgtcacccaggctggatttcggtggcacgatctcggctcactgcaagctccgcctcccgggttcacgccattctcctgcctcagcctctacgagtggctgggactacaggcgcccgccactacgccccgctaattttttgtatttttggtagagaggggtttcatcgtggtctagatcgcctgacctcgtgatccacccacctcggcctcccaaagtgctgggattacaagcgttagccaccgcacctggcctctggacagtgtttttcacaggtcagattaatttttatataaatcatttattttatttttattatgtaaaattttataatttttaattttatttttaatttcctttttaaaagttaaataaaattttaagtgtaatgatgcaaaattttgtttaaaagtaaatgcatataaaaatgttgatatagactaaaaaattgaataagtaagaaggtagttagttgtcacagtaggagtgaagtgaaaagcttcccctttcaccctctgaagattaccggaaatgaactgaccatacacagattaataaaagaaagggtatacaaacttacataacctgcaaaaacatgagagctatacacaaagtataagacttgaagacggctcagatcttaaacgctctcctcataggcaatagatatatagacccaggatgcagacattattttgtaaataatttcctttggaagctggatgggacagacaaattacaggaaggtgagagatggaactgcacaggaaaaaagtttgtctttgtcactttaatcttatcattactagagaatatttatgaatattttagaataatatatttttaagcccaaatctcaccaaatgttttttctaaaacaaatactttttgttgttgtttgtttttgttactgtgtctcactctgtcacccaggtatggagtgcagtggtgcaaccatggctcactgcagccttcacctcctgggctcaagtgattctcctacctcagccttccaagtagctgggctacaggcatgcaccctcatgccctggtaattaaagaaaaaaaaatttcgttagagaccaagtctcattatgtcaccctggctagtcttgaactcctggaatcaactgatcctcatgccttggcttcccaaattattgggattataggtgtgagccacagtgactgaccacatatttctatacttcactgaggaaaggaaggtgctaggaaaattggttaagaactattttttaaaaagctattagtagtgttttattttattttttaatgattgatttttgagattgggatctcactatgttgcccaggctggtttcacattcccaagtttaagcaatacccctgcctcagtctcccaagtagctgggatgacaggtgtgtgtcaccatacccagctccattagtagcgtttttaacaattgtgggccactgagtaagaataattttttttaaattaaaggttattttttaaaaagcacatttgtagaaaattactagcataatctgcctaaaataaatatacatattgaaaaaatctttgctccgaacaaaaagaaatatattcaccacacatacatacatatacacacacacacatgcacacacgcacgcgcgcgcacacacacacacacacacacacacacacacattatggaagatttcaagaccaggcaataatttccactcaatccaaaaacaatgcaatcccagagctgaatatttaggtgaaaatatatcaggaatgggaggcattcaggtttaattttcatgttttggtagagttaggatgtgagttttcatttaaaaatattctttattttttttgctactattgtggtttctgtattgttactatacaatctgtaaactaaatagtaaaggagagaaaagtgattttcaaagaagctggcttgggaacaggtactattctgggaagatgaaaggtttcacttaatgactggtacctgtgccactctggttattttaactgttaaccttttagcaagaggtttttcttttaaaagacatcctttaatatttgggaagctagtgcaatagtacacattgaggcccacataccacatgccaaatatttaaaaggcacatttctagctaaccactgtacatacatatattttttcttattttctgattttagtttttttccttgtcaacaatttatgtccacacatatcttctatcatcccactttgacaagtaatattataccttcaaaatgatgtggaagactagattggaatttagaaccgtagaaccttgtaattgtacaggcaagtttcttcctgggaaaaaataaaacaggaagaaaaggctgggcagcctctggttcaggaaggaaattcaggagtcccttatagcagcatctctagtacttgggaaccgaacagacttctcggcctgtgaggctggaatgggcccttctggagaacacgacagagaagttatctactgcctttgcccccagggcccaggcaacacttttaccctccattgtttccgaagttaaggggaggagacaatgttttgtttagtgacctcgacagaaaaagtgtcctcctgcaaccactcatttgttactttccttcttcctgaattgcctggacccactcctcctccatttgactggctctgtgcactgatcttatagtcaggagatttttgggaattgtggcttctaaaaatgtacacccgactctacccatagctggccctgtgaacctacacacctgctccactgtgtatccttctcaaagagacactcttcctgctgagtctctgccctctgctcctagatccaaatggcatctcctaccctatccctgtatggtttaacctagggaaactctttcccagaggagtcaggtaaggagacagtggctgagcttcttacagacttaaaggagacatcctggaatttaggagtcagtccttcctttctgtaatccctggcagctcctgctgctgctcaaagtttagctttgtctctcatccagctcagacttttgctggtcctgatggcctctgcttagctgtattagtacgctcttgcattcctataaagaaatacatgagaaatacctttagttggctcacagttccataggctatacaggaagcatggtggtttctgcttccggggaggcctcaggaaacttttactcaaggtgcagggcaaaaaaaaaaaaaacaaaaaaaaaacaaaaaaaactaccagcactgcactgtgaggccctgatccctgagctaacttcatattattacctctacagcaagtgtccgtgagaacatagatatatttcttatgtgagtacacaatttacagaagaggaactaccctcccaaaccaaaacgtcataattttaatttaccagcaaacctaggttgcttctgtgaaatgatctcatttgctgagttttaaaattgactaaatttcccaatttccaaatgaaaatatttagttatcttgtcttgctatgtgtttttggttaatatgatgattaatttttggtctattacttaatatattccatgattgttgatatggattataaggactcacaaaatagttttcagatgtctttaatttttttacttagtgtagatcctataaatggattagaagtattctattaactcccatgtattcagaaatcgaattggagtggtaaattctgtttgaagtaacaagggatatcaaaggaaaaaaataattttgtgactatgtcttctatacgtaaatttttcaggcatctttatcaatggcttatactaaagacattttctggatcatgggtgacacacagaagacctgtggataagtggcattgtgtacactactgcattttatcatctggttcatttttcaacttttatttctcttaaggatgttttattaactggtgcatcaccaggttaccagtctctggaacactaaacttaccagaaaatacttgttgattgaattaacaagacaacaacattagaaaacagtggtggcttgtttttgtccattgcagtatcttggagagtaaagcctaactctttaattttggccaaagatataaagaaatacctgagaaacacctttagttggctcatggttccgtaggctatacaggaagcatggtggtttctgcttctggggagtcctccaacacttactggcagggtaattttgaagaagtcataataagatggttgttacaattaaatgaaataatcaaagtggaagagcttagttagctgtcttccctaaatgaatcactggcaagtaagagtgtgattgattttcctaccagtcaggactcaccccttgaagctataggagggtaaacctctgaagaccatacaatttagggaacactaacacctcaaaaaactctgtaaacttccttccttccttttcttccttccttccttcctccttccctccctctctctctctctttttctttctttgttcatttctgagacagagtcttgctctgtcattcaggctagagtgtagtggctggattatggctcactgccgccttgacctcctaggctcaagcaatcctctcacctcagcctccctagtagctgggactattggcatgctcagctaatttttttctccttttctttttgtagagacagggtctcatcatgttgcccaggctggtcttggactccttggatcaagcaatcctgctgcctcagcctcccaaagtgctggattacaagcatgagccactgtgcccagccttaagtttttttcatacaggaggaaagaatttggaaagtaggtgtgtgtgtgtgtgtgtgtgtgtgtgtgtgtgtgtgtgtgtgtgttggttagggagccaacacatttttctgcaaagcttgaattctatgcctcagtttttcatttttgttatgtgcaaaataaaatcgtatcctgctatagatttaaacctgtgagcgaatcctactcaaaacctgattcaaactttgtgtagatctttgcctctctgtggcataagaataaattcttctggttttcttccctcagaaaaatggacttagacttcccacaagccttccagaaagaactcacctgcctcatctgcctgaattacctcatagaccccatcactataggctgcgggcacagtttctgtaggccctgcctctgcctttgctgggaagaagcacacactcctgccctgcatgcagggaattgtcacagcaggaagatttcaaccaatattcttctgaagaatctagtgtccattgccacaaaagccagtctctggcaattcctgagctctaatgaacaaatgtgcgggatccacagggagacaaagatgttctgtgatgtgggcaagagcctgctctgttttctgtgttctaactctcaggaacactggggcacagaaacactggctcactgaaggggcagctaaggaacactgtgtaagtgatgactcagagcactttgaaagctggagggcagcacaggtaaagagattaggaggaagatgaagagcacgaggattaatctattctttaccgagtgtcatgtactgcctaggtatcagtgatataactattatcctgctatcaaatctactgataagtggctcatttaacttataggcactcatcacaatgcaagaaatcctctgactgctcctaccatcatggcccctagccatgatatgacttgtctccacactagcagaaactaatcgagtccctatattagggataagtggcatttttatatatatatatatatatatatatatatatatataatttttatatataaattttatatgatatataaaacatatttatacaatatatattatatacatatatacatacatatatacatacatatatatatatatatatatatatatatatatatatatatatatatatcacaatgccaaaaatgttttgtcttcgaaataatcacagtgcatttggagagacaaatgcatctacaaccaggcgacaacactgaaaataaaattgtagcagtttgaataggggattaaatgagttaattttttcctggggttcaaaaaaagaaacagcagcaaaaaatggtacttaagattgaaagttggccgggtgcagctactcatgcctgtaatctcaacactttgggaggccaaggtgggcagataacctgaggtcaggatttcgagaccagcctggccaacacggcgaaacaacaccattactaaaaatacaaaaattagctgggcatggtggcaggtgcctgtaatcccagctactcgggaggctgaggcaggagaatctcttgaacccaggaggcagaggttgcagtgagccaagatcacgccattgcactgcagcctgggtgacaaaagcaaaactccatctcaaaaaaaaaaaaaaaaaagaaagttctgggttatgacacagaacaaatgcaacatgaatatgtcatggttatgaacatgtagactactcaagattgtgtatttttaaaataatagaatactaggttaaaaaatgagcattacaaaatgaaaaataagccacaaattagcagaagataattgtaacacataaaaacaaaggattaaatacaatggtaatgtaatgatagctattcttacaaagttgtttctatgtctcaggtactatgctgaacaacatacgtgcatcttgaatgcgtgaagaattcctatataagaaaaacacaaacaacaacatttaaaatgagcaaaaaacccgaataggaatttcacagaagagaaaacataaatggcccataaacataataaaagatactcaactacaattctaatcagggaaataaatattaaaaccccaaagagataccacttcatactctaggaaaaacctaaaaggctgtgaatatctagtttcattgaggaagaacaatgggaagactattcactgctggtgagggtgtagattggtacaactgccttggagaacagtatgatgccactcaatagagctgaacacacacatgcccaatgaccaagcaattccactccaggtacatactggaaaaatactcctgcacaagtagaataggagacactgcataacaaagttcactacaacatgaggctgaggtgggaagatggcttgagaccaggagttcgaggctgcaccagtagctgggactataagcatgtgtcaccgtgcctggctaattttttgctgttgtggttgttgttagagatgaggtcttcctttattgaacaagctggtctccaactcctggcttcaagtgatcttcccacttctgcctcccaaagtgctgggactacaggtgtgagccaccatgcccagccaagttctgcttcttaacctgaggtagatactttgatgtttcattttgctttattgtacagatatactttatattctcatatgtgacacaagtcaaaatttaaaaaaacaatttaatgtttattccctttagatgaatgatgggcaaatttacataatgaattcattactgaaacaatgtatagatttcagactaggaaagtaactatttataaaagaaaagcttaaaacctgaaacagaaacaaaatcctgaaactgtaaaattgagtcaaactaaaatttaaaaaacaaagcaatgatataaagtatcatttgtccaaatgtgttctacaaaacgcttttttcttaaatatgtctgaggaaaaacaggttctaggagtaaaatatgtttgaaaaatgctgagttaaacaactgaacctatgaaggaaggaatagaacttctcaagctcttgactctggaatcttttttacatggcaattaacaccatgcttcttcttggatttgtatttcagataaacacaatctgggaaacattttataatacagagggccacaccagattgaatattgcccccaggaatgaaatgaaaacaggaatggattctccagtaagaggtacccagatatcctaatcttcagtagctgacctaaaccctggacaagtgggatcaaatcccataaccaaacacaactttttaggaactaagtggataatcactctgtgttgtatgaacatgtgggcagtgtgtttcctacacagcttaaaagtgcaacaaaaaaagatctaggtgtcatataaagaatttctaccactgttagggtaatggtggactgacaggcagaggggctcagatgtgacttaagtaaagttcaatagaagcttccagcacagatattcatgtttcaaattggaccactcagttaaaaagttttcccattagacttcccctaatcaaattagaaattatctaattttctaataaagttttccccaggcacaaggaatctgtgaactggacctaaaaaattcttcgtaatgtacttttattaccataaaagatgcacatttattttaaaaacttctctacaccactatcataaacctttgcacacacttatttcttttggaagctaacttctgagtggtaatgaaatatattcttaagaaaaaagtccgacacaatgcctttgcgtcttaaaatatgttaaaatattatttgaaaagagtcaaacatctgtcttttcagggtatcacagggcgtcaaactggaaaatgtggcactgcctggagtttctacctggtgaagggtggcagacttttctcttcagaggactcttgacagggtagcatccattatcttgccaatttactacaacctaggcccaatcctcagtcttataggttcagaaatttatttttatcagcatcaacagggtagctacattgcttagaagcaaacaaaattaaccatgcttcaatagaaatcaggatatagatgtattaatacagaatgacaaatataactgtgacagaaataggaatgcctgtttatggtcatatacggccaatactttcattacagccaaactcatatatgcagccaaataagaggcccctggatacacagggaatcagaataaaaaaagaagaactgaacatttaatagtcttctttcattcaatcaataattttttttaattaagcaactactatgtctgggtaaccttctaggtcctggggatacagaggtctctgcttacagaagtcatatgtaagtagcaggtgaagagtatgtgtttcacagaagtttattacaatatattaacaagagcaaaaaattttggaagcaatctaaatgttcaataatagagctccaattaaataacaataaatccaaataatgaaaaataatgcagccctttaagaataagcacttgcaagccgtaattcatgacatgggaaaattatcataatggaaaaagaagcaagctatatacagtgcatgatcctatacacacacatacatacatacatatttcctatccctttatatgcataagaaaacaagcgggaggaaagtcgtatctttagtcaagtcttgtttactaacgtactattaatgattatcttttctttttctttatacctttttgcatttttcaatttcctaaaatagccttacatgccttttatcaccaggagaaaaattacttctaaagtaatttcagtcaacatgcatactaagaactcttcagatttatctgttagaagctgtgcatgaatgccagtccttgcatctgtcttggaactcacagagagctcttttcccatggctttaagcaatactcaaaaagactagcatacctgaatttcctagtcctatgtttttttcatccaacagccagtcttgtatttctagctgttttctaaacatttcaaccaaaccattttacagataactcatacagtcatcctttgatatgcatggggaattggttccaggatcccccttgtataccaaaatccatggatgctcaagttactggtataaaatagtgtagtatttgcatataacctacacacatcctcctatatactttaaataatctctagattacttaataacaattaatacgatgtaaatgttacgtaaatagttggtataccatgttgttttttatttgtatcattttttatcgttgtattgttttttctgacaattttgttccacagttgtttgaatcagtggatgcagaacccatgaatatggagagtcaattgcattttattatgcccaaaggtaaatgcataatttttccacacagctaatcttctagcaaccccattgctgtccatggcaaacaggcttagttaatctcgccctttcccgtttcaggttcattatacaccatggaatactatgcagccataaaaaatgatgagttcatgtccttactagggacatggatgaagctggaaaccatcattctcagcaaactatcgcaaggacaaaaaaccaaacaccgcatgttctcactcataggtgggaattgaacaatgagaacacttggacacaggaaggggaacatcacacaccagggcctgttgtggggtggggggaggggggagagatagcattaggagatatgcctaacataaatgatgagttaatgggtgcagcacaccaacatggcacacgtatacatatgcaacaaacctgcacattgttcatgtgtaccctagaatttaaagtataaaaaaaataaaaaaataaagaaagaaatagatgttctgtaaaaatatacacaatttttacagacaaatacatttataagttgtttttatcttaaaaattggggatatttcatatttataactaaatattgagccttaagttttcttggccatttctaggctaataaactaagaatcatgtaaactaagccaaagtagaatagacataaaagtcctgaacacttcaacttcctatccttcaagaagtatacctcgcaaagctcatttgagagaggaaaagctttcctccaccctcggttttacagtgctgaggcttctcatcacatttctatgacttgtagcttaaatccatgttacatggtcactggcattgttagtgcttctcttttaacactgtaggaattaatcaatttggtggcatatttaattaattctatcactagaggattgtaaaattacatatatgaatacctcactttagaggccacttaatttttttccaaggggatatttgactatatttcacttgtgtcttatttaatgattttataatttaaaccctaaattataaatctagaatttagaaagtatatttccccactggattacatttttggaaatattactttatatgtgcacaaatattacaaaatcactgtagacacctgaaaactatattatcttttaaagacaatatttacattaaactggtataacaaaattgtttggtgcattttttccagtacattttgtgtatattacatgtttaacctttttttattcagcaaataatttttgagtatctactaagtgctaggttctgcattactaactgaatttaaagagtgaaataacagacatggtctcagacaataaaaattaacattaggtcacttatttatatatttttaaatggtaattatgaaaactttttgagatttttaactagataacattataataacgcacttgatgttgttaatagttgccagtgagcaaaaaagaaaataaaaagatggttttattcaatatacactttaaaattgcagaaaatagtcaagtttctctgctttgcagttgaatgtctatgtgtttttctctgcaacttggcttttgtggagtgaaacaattattcttccagcccaatgaaggcagacgagtaacaataaatctaatattttaaatgcttatcaaaagatagtaaacacattatttcagaatactgagttcaataagttgacctacaaaaaaagccaaactgacagtattactgaataaggaaaggcccaaagagacaaaatactttttattttgtaacctcggtatgacacaacttaccctaactataaagaccctaaattaccaagatgggtgcttataatatggagagttacaaagtcatttcacttttagcttttttatttctctcagaataaaaagtgtataaggagttgataaagaagttgatactataagttagtactacaatgacagcacttttcaagaaaagacttttttctctcttacaaatatcatgttagcagtatttgttttctccagaaataatgagtaaataaaaacataagtatgtgggtaattagtgtagtttcttaaataaatgagttaggcaacaggctaataatgtatatttcactggcttttcaatgccaacaatcatattctttataaggcacagagaagatttttctaaagaataagtatgtgaacctgaaaagtaatcaccacttggtagtgacaatatggatagggtgaagggcgtcaccaagaagcaatgaaaagatacatttgcagttaaatttgaaaaccatgatgtttaatacatatagtaataaagaatactttctcctgtctcaaaattattttagaatttaagatagaagctaaaatacctagggataatgatatgactatcaaaaattaaaaattaaaggatattttgagtattataaattaagaatgagaacttattacccaatgaacaggggataattcattatgctccatatccattgaattaaaagacaggcccattacctggataatttgaaagtttaattttatttaaaagtcttgtttcattcatcaagctaaaggattagctcccagaaatattccaggattgcatatccccaactctgtaggaagtatagaaagaatgttataagggccaccatctaaacattattatataaataatttagtaccattccatttgcctttgtagatttaaaaatgtaaatggctttctcatattaggaaacatcacttttcaaaacccaggtaaacatagtatattgcaagagaataattattttctttattaaaaaagaaatactggatgctaagtccaaaagacataaattattttatactaataactactaatattttattcattaaaatataaaggtcaaagatttcaaaatgatctttaaatgattaataacatgttgatctttttcttctttctgtaaacctttttgagtcttaacaatactaaactatacaagcaatattaaatagtatataaacttggattaaaatattcaaatttactagaatgtggacattggaaagaatgaaaataaacagaagcataaagcagcagatataaaattaagaaagcaactaagagtgtttaaagtgcatattcatctgtagtctaatgtctaccataaacaatgactcttctcagtaaaacacaaattgttcatgaagggaaaaagcatgttgtattagagcatattcaacataatttttttagtactaacttgtgcctggagtattattggtttttctattatgaacttatgcacttggtaatttttttcatcaaaattgtatgtacaactccattcaaaagcagtttttggtcgttttttttttttttattttgagacagagttttgctcttttcacccaggctggagggcaatgatgcgaatttggctcacagcaacctagcaaattttgcctcccaggttcaggtgattctcttgcctcagcctctcgagtggttaggactacaagcatgcaccaccatgcctggctaattttgtgtttttagtagagacatggttttgccatgttgaccaggctggtcttgaactcctgacctgaggtaatccgcccaccttggcctcccagagtgctgggtatgggcaagagccaccatacctggcctcaaaagcagtttttaaaagcaaacacaatataacaccgaagttgaaaaatccatgctcactcaaggatgccaggtttaataaattattgatagaatactacatcaaaaataagacaataaaccaaaatataccattaaagatgtatccactcctacaactagagataactaatctatctggtagcaaatgatacttcaatcagtttcagcatgtctgaaatctttaaggacaaaagtgataaaacatgacttcattcttcattagcctcttagaacacttgaaggaaaataatttctgaagcacgaagaggtaaagaggtgtaatctttcaaaaagatattcagtgttcaaaatccaagagtgcaatatcaggctgggtgcggtggcttatgcctgtaatcccagcactttgggaggccatggtgggtggatcacctgaggtcaggagttcgagtccggcctggacaacagggtgaaactctgactgtactaaaaatacaaaaattagccaggcatggtggtgtgcacctgtagtcctagctacttggggggctgagacaggagaatcgcttgaacctgggaggtggaggttgcagtgaaccgagatcatgccacctcactccagcatcagtaacagaatgagattccatctcaaaaaaagaaaagagtgtaatatcggtatacacagataatatactgaatgaaacaaatagaataatttgaagaggtatcttgatgaacaaggagtaattagaaaggttgtatttatgtctttgaaggaaattgcaatgtgagaaattaatactttgactactatactaaaagtttattgctaacatctattgagttattaacgtgtgttaggcagagtaccatataatttacaagtgttatctcatttattgtaggtaaaatgtaatttcaaactctgggagtataaatgaattagatagaataaaattctatttaaatggccatcagtaaatcggtatctaggaacagggtgatacagtgcccaagttttctattcttactaaatgttgtgtttccttttcaatgttttcttggatattgctcttttttggtgattttgattttttttattttagaaaactaataaattgactcttcttggtactgactcgggttttatagaagaaaaagtaattaaattctgtacatttacctttacctcattttttctcttttaaatttactttaattgacatacaataaatgtacatgttatggggtacagagtgatattttgatatatttatgcaatgcgtaaagatcaagtcagagtcattatcatatccattacctaaatcatgtattatttctttgcagtgagaatattcaaaatcttttcttttcgttatttgaaaacacacaataaattcccattaactacagtcacccaacagtgctgtagagaactagaacttcttccttctctccagctgtaattttgtatgtattaagcacatttttcttatactcttctttctcctactctttccaggatatggtaaccaaaactctactatctacttctacgagattaaaaattttagcttccatacataagtgagaacacgtagttatgtggtgtttatatttctatgccaggcttatttcacctaacataatgccctccacttgcattcttgttgccacaaacaacaggattttgttctttattatgactaaataatattccattatatatgtatgtcacatttctttatccattcatctgttgatggacacttttgttgattccatatcttggctattgtgaatagtgctgtaataaacatgggggtgcaggtaactctttgatatactgattttctttcctttggatatatactgaaaaccatatgattaaattaataaacacaataaaagcgtttggcaaaattaaatattcttacatgacaaaaaacttctcaacaatttagtatagaaaatatatgccttaacacaaaggacataaaggacaaatctacagctaagatcatactgagtgtggaaaaggtgaaagattttactgtgaacaagaaaaagattttactggaacaagaaaaggatgcctattctcaccaatcatatttcacatagtgaaagtcttagccaggacaattaggtgagagaaagaaataaaggacatctgaattggaaaggagacagtcaaattgtccttgtttaaagacaatgtgatcttatacatggaaaaaaataagactctaccaaaagcttctcagggtgatacatgaaattaatatagttgcaggatataaatcaacatacaaaaatcagtagcatttctatatattgatagtaaactagctgaaacaagaaattaagaaagcaattccttttacaatagctacaaaaatgtacttagaaataaatttaaccaagtaaaagatttcgacaacaaaaatgacaaatattaatgaaagaaattaaagaaaacataaaaaagcaaagacatccacgtttatagattgaaataatattcttaaaatgacccactatcctatgtgatttacaaatttagtacaatcactagcttgtatttttaaaagcacctttgctgcatattcttaacatattcaatgacaatgcctggatttgaggtattattatatctattttatactgggcacaatataatgttatcagaggtaacggttttgattggtcctaggtcatacagtaatatatacattgtcatttatagacatgctatcttttaatactcaggcatttagaaagttcatttagacaaagttataaaaacttgccttcctttctgcctatatcacctaaaaatcctaatttaagaggtaataacattttttatttgatatacaatttatcaacacaataaaaatctaactatcatgtgcagagtgtgaaaatctcatcagattaaggaacacaaagacatctttttcatattttgaatgtaaaactgttttggaaactgttatttttagaaacagttaaaaacattgtttcattagtttttcatgtaaaattgtgacaaccagcatgaaataactgtcatcacagaagcatggtatattcgattccgaaacatattctttgtaagttttaatatatttatgtattatttatacttaattgtaacccataatgtacagatattatttttccttcaactcttaagaatattcttaaataataaaattaatgaattataatttttgttggttgggaaaaagacacacacgtgacagtgcatcacttcacctcatcatttcatctcatttcatcttatcccatctcatctcatcatttcatatcatctcatcatttcatctcatcatttcatcaaatctcatctcatctcatttccatttcattttcattatttcatcatttcatttcactatttcatttcatgtaatttcatttatttcattatgtcatttcatatcatctcatttcatttcatgtcatattttttatatcatttttcgtatcatttttcatctcatttcatctcatgtcatattttttatatcatttttcgtatcatttttcatctcatttcatctcaattcatttcatctcatcatttcatctcacctcatcatttcctcctttcttttcaacatttcatctcatttcctctcatctcatttcaattttatttcgttatttcatctcatttcattatttcacctaatttcattatttcatctcatctcatctcaatttatctcatctcatcatttcatctcatcatttttcatctcatcatttttcatctcatcatttaatctcatttcatctcatttcagctcatttcatgtcacatctcttcatcatttcaacatttcatttcatctcatcatttcatctcatctttcaatttcatttcaatatcatcaattcatcatttcatttcacttcattatttcattatttcatttcatttcaattcatctcatcatttttcatctcatcatctcatttcatcatttcatctcatttcttctcatttcatctcattttatctcatttcatctcatctcatttcaatttcatttcattatttcatttcacttcatttcatttcatctcatcactttatctcatctcatttcatcaaatcatttcttctcatctcatctcatttcatcatttcatctcgtttcatctcatttcatctcatctcacctcatcatttcatctcatcctttcatttcatctcatcgtttcatctcacctcagcatttcatcatttcatctcatcatttatttcatctcattttatctcatttcatctcatatctcaattcaatttcctttcattatttcatttcatctcattcatttcatctcatttcattacatctcatttcctctcatcattacatctcatctcatcttatcatttcatctcatcattgcatctcatcatttcatctcatcattcatctcatttcatctcatcatttccatttcattatttcatttcatcatttaattttatcatctcatttaatttcacctcatttcattatttcatttcattttttcatttcattgtcatttcatttcatctcattacatttcatctaatttcatttcacctcatttcatctcatcatttcatttcatctcatcatttcatcttttcatctcatttcatctcatcatctcatcaactcttttcatcttatctcatcatttcatttcatctcatcatttcatctcatctcgtatcttatctcatttcaatttcgtttcattatttcatgtcatctcatctcatctcatcatttcatctcatcatttcatctcatcacctcatcatttcatcattttatttcatcatctcatcatttcatctcatctcatttcgattttatttcaatttcatttcactatttcatttcatctcatcatttcatctcaccatttcatttcatcatctcatctcatcatttcatttcatcattcatctcatcatctcatcattcatctcatcatttcatatcatcattttatctcatctatcatttcatctcatttcatctcatctcattccatcacatttcatctcattttatgtcatcatttcatgtcatcatttcatcacatctcatctcatcatttcatctcatcatttcatcatttcatctcatttcaactcattgcatctcagctcatttccatttcattattccgtttcatcatttcattcattatgtcatttcatctcatatttcatctcatctcatcatttcatctcattttatctcatctcatttcatcatttcatctcatcatttcttatctcatcatttccatttcattttcatttcattatttcatcatttcattattttatttcatctcatttcattcatttcattatgtcatttcatttcatctcattacatttcatctaatttcatttcacctcatttcatctcatcatttcatttcatctcatttcatcttttcatctcatttcatctcatcatctcatcaactcttttcatcttatctcatcatttcatcatttcatctcatcatttcatctcatctcgtatcttatctcatttcaatttcatttcattatttcatgtcatctcatctcatctcatcatttcatctcatcatttcatctcatcacatctcatcatttcatcattttatttcatcatctcatcatttcatctctcatttcgattttatttcaatttcatttcactatttcatctcatcatttcatctcaccatttcattccatcatctcatctcatttcatttcatcattcatctcatcatctcatcattcatctcatcatttcatatcattttatctcatctatcattttatctcatttcatctcatctcattccatcattacatctcatttcatctcattttatgtcatcatttcatgtcatttcatcacatctcatctcatcatttcatctcatcatttcatcatttcatctcatttcaactcattgcatctcagctcatttccatttcattattccatttcatcatttcattcattatgtcatttcatctcatcatatttcatctcatctcatcatttcatctcattttatctcatctcatcatttcatcatttcatctcatcatttcttctcatctcatcatttccatttcattttcatttcattatttcatcatttcattattttatttcatctcatttcattatttcatttcattatgtcatttcatttcatctcattacatttcatctaatttcatttcacctcatttcatctcatcatttcatttcatctcatcatttcatcttttcatctcatttcatctcatcatctcaacccttttcatcttatctcatcatttcatcatttcatctcatcatttcatctcatctcgtatcttatctcatttcaatttcatttcattatttcatgtcatctcatctcatctcatcatttcatctcatcatttcatctcatcacatctcatcatttcatcattttatttcatcatctcatcatttcatctctcatttcgattttatttcaatttcatttcactatttcatttcatctcatcatttcatctcaccatttcatttcatcatctcatctcatcatttcatcattcatctcatcatctcatcattcatctcatcatttcatatcattttatctcatctatcatttcatctcatctcattccatcattacatctcatttcatctcattttatgtcatcatttcatgtcatcatttcatcacatctcatctcatcatttcatctcatcatttcatcatttcatctcatttcaactcattgcatctcagctcatcatttccatttcattattccatttcatcatttcatttattatggcatttcatctcatcatatttcatctcatctcatcatttcatctcattttatctcatctcatcatttcatcatttcatctcatcatttcttctcatctcatcatttccatttcattttcatttcattatttcatcatttcattattttatttcatctcatttcattatttcatttcattatgtcatttcatttcatctcattacatttcatctttcatctcataatttcatccatcatttcatttcatttcatcatttcatctcatgatttcatctcatctcattatctcatttcatctcattatttcatctcatttcatctcatctcatttcatcatttcatttcaccattacatctcatcatttcaactcatctcatttcaatttcatcattacatttcataatttcctttcattatttcatttcatctcatttcattatttcatttcatttttcatctcatcatttttcatctcatttcatttcatcatttcatctcatcgttcatctcatctcatcattttatctcattatttcatctcatatcatctcattacaatttcattatttcatatcatttcattatttcatttcatctcgtttcatctcatttcatccatcatctcatttcatctcattttatctcatctcctctcctttcaatttcttttcaattttgtcatttcgtctcatcatttcatctcatcatttctactcaccatttcatctcaaaatttcatctcatcatctcatctcatcatttcgtcatttcatctcatcatttcatctcaagtcatcatttcatctaagtgaaatgatgtaatggaatcatgaaatgaaatggataggatgccctcagtgatgttaaatttaaaaattgtttcttttcatgtatgcatttttatatttatatttacttatagttattactttttatttatatttttacttatttctttatttataaacaaggtcctgttctgtggcctaggctggaatgcagtggtgcattcacagttcactgaagcctcaagcaaacctcccaccttagcctcccaggtagctgggaccccaggtgcgcaccaccacacctggttaatattttattatttgcagagatggagtcttgctattctgcccaggctggtctcaaactcctgggctcaagcaatcctcctgcattggcaacccaaaatgctgggatgccagatatgagccacagtgcccaacctatttatttatttatttatttatttatttaataaagacaaggtctcactatgttgcccaggctggtcaactcctggactcaaatgattctccaaacttggcctctcaaaatgttgggattacaggtatgagccaccatgcttggcctaaaaatagtattatatttttgtatcatataattttcaattaggtattatgaatattctgtacaggaaacacacccttaattacataagaataaacatttgttacactgagaaaaatctaatagagctaaaaataaaaattaatttggaaaggtcattagatactgatacattcttacgtttatacattctttcatatattcatatatccttttaacagtatcaatggtttggagttacgtgtacaaagccatgacccatatgtaatacaactaataacaggcacttacaattcaaggcatattatatacaaagctttaacttcttatcaaaatattttacttttttctttctgttttggcagatactatgaacacaacattcaactcacagacaccatggagcccttactaagcataaagtactgtgaaaggccagggctaggacagaactgagacagggccagggataggacagaactggggcagggtcatggccagagaaaaaccaggggcagggtcacagccagggacatgagaggaccaaggccaggtccagaagcagggaagaaccagggccagggcagggacatggcagggccagggccatggcaggatcagggtcagcagaaggccagggcagggctagggtggcacagggccaaggcagggcagggtcagtgtagagcaaggaacgggccagggtatggcagggcagggacagggaggtccagggccagagtcaggtccaggacctggacagggcagggccagaaacatggcaggaccagaaaggggacagggcaagggcaaggccagagaaggaccatgggaaaaacatggccagggagggtccagggcaagggcaagtccagggcagaaccagagccagagcaggccaaaggcagggccagggcagggcaaggccaggatagggcagggccagtgtagggtgagggtaggaccagggcgagttcagggccagggcaggactaagatagcacagggctaaggcagggccaaaaggaggggccagggccaagcatggccagtgtcagacctggggattgtcagggtcagggtcaaggctggtccagggacagggccagagcaagggcagggccagggagaaagcagaaccagagaggatccagagcaaggccagggtcagggcagaaccaggaccaggataaggcaaagccaaggccagggcagggcaaggccagggcagggcaacaccagggaagggcaaggccagggtagaaaaggccagggtagggccaggccagggtaggagaaggccatggtagggccaaggccaaggcagggcagggctagggtagcacagggcacggccaaaaacagagcagggccatagcagtggcaggactagcaacagggctagggcaagcgctggaccagagcatggtggggacaatatagggccaggacagaggatggcaaggcaggtccagggccatttcatggactcagtaggcctggggtcaggccagggcagggcaaaggcaaggccaggaagaaggcagggccagggccaaggcagtgccagggcagggcaggaccagtgcagggccaatgcagggtgagggcaaggccagggcatggaagggcagggcaggatcaaggaagggccaggagagggccacggcagggtcatggcgagaacaagggtatggctggggtcaggaatatggtaggatgagggctgggcccaggctggggcacgcagggcagagcatggtctgtgcaaggcatggccagagccaggccatagagatgggagggcaacaccaaggcagagtcagggtagatccagggctgagcagagtcagggcaggtccagagtcgaggcagagctagggcccaagcagcgccatggtagcaccagggcagaggagggcagggcaatgcaggactgggccatggcagtgcctggtcaactccggggcagggccagaagcaggacagggccagggccaatgctcaggccagggacagggcatgacaggacgtgccagagcagggctgggccaacgttggggcagggcaaatcagaccaggacacctccaagtccagctctggccctgccttggccctggccccttcctggcctgaccttgtccctggccctgccctatccatgccctgtgtgtttgaccagtgttttataaccagaatcctacaagaaacttaaattagttctttttgtgcatttttagtagagatggggtttcacaatgttgcccaggctggttccaaactcctgagctcaagccatctgcctgccttggcctcccaaagtgctgggattacaggagtaatctggccaagtatttaccttctttttgcctgtttcctacatttggaaaatggggatgctttaagtacctagcatatagaattattatgagaatcaatgcctcacatatttacatgttgataaaattatactcatagaacactactggaagcaaagatagtattagttaaaatttagtgattactgcaagtattattactattacaaacaacatagtatagacattactactactatagttatcttaaaaatctaaaataaaaattttagtaatagcctaaagtaatctctcctgctctgccctggctcagccctagtgccggctctgcccctagtcctactacatccctggccctgacccttccctggtccagccgctgccctggcccttcccatcttcaggccttaacatggccctaccctggtcctgaccctgccctggtctggtcctgaccctggccctaccccagagaaggggtatggcagagccagggaagggccggggcaaataagggacaggacacatccaaatccaggaacgggccagggccatgacagagccagggcgagtccttggcagggccaggttccaggccaggaccaggaaaatgtcatggcagggtcactgtatggccaaggtccaggccaaagccaaggcagtggcagggtcaggtctgcataagggcaggaccagagccagtgatacggcagggccagggccagggccagggctgtgccaggacagaacaagagcagagcagggcaggaccacagccaggccatagagagagtagggcaaatgccaaggcaatgccagggtagtgccagggctgaggcaaggtcagggaaggtccagggctgagtcaaggctagaaccaagatggggcaaaggccggggcagatctagggcacaagcggggcagatctagggcacaagcagggcaagctagggcagggcaatggcaagaccaggccatggcagggccagcccaggatagaacagggcacaggcagggcagggccagggccacggctggggcaggacaaggaccaggaccggggtccaggccagggcaagggtatggccagggcagaggtagggccagagccagggtctgggcaggaccaaggcaggtctattgcagggccagggttcagaccagggccagagcagggctgggacagggccagggccagaaccaggaaagggcaatgtcaggacaagggccatggcaggaccagcaacggggctaggaccaggacagggacagggacagggtcagggctagggccagaatagcatgccagggtagagccaggccaaattagggccagggctgggccagggtatggccttaagtagtgaagggccagggccagggtccatgccagtgccagtgccggtccagggcagacgcagggccatggccaggtctaggacaaggctgtggcagggccaaggtctgggtcagggtcagcataagaccaggacagagccaggggagggacagggccatggtaagaccaggttaaaccatgaacaagacacctgcaaatccacttcagggccagggcagggccagttcagggccagggtaagggctgccagggtcattggcagggccagggccatggcaggaccagggtcaggagcaggggtcaatgccaggccaaggccacagataggaccaggtctgtgctagggccagtgtgagggccaagacggggtcagggcagggccaaagggagggcagggccagggcagggtggagcaggcccagggtagcacagggttaaggtagggcacgaccaaccagggcaggtctatggctggggccggggcagggccagggccggggcagggccagagccagggcagggccaagacagtggcagctccagggcagggccagggttaggaccacggacatgtccaaggccagtgccagggcaagggcaagggcaggggcaggggcagggtcatctaagaattagggacaaagccaggcccagagctgggccaggaccggtacctgcagggctagggtctgggccagggccacaaccaggtctgtgctatggccaggtccaacacagtgccctggtaaggctagggtgaaggccaaggtagggccagggcagggtcaaagccaggctagggccaaggcagggccaggaaagcatagggccagggcagggcagggccaggccagtgccaagacctgggcagggccagggccagggccatagaaacggcctgggcaggaccaggtttggggcaggagcaaaacaagggaaaggacagtgcaggttcttggcacagccagggtccaggacagtgtcagggcagggccaaggcagggtctgggccatggtaagaccagcaacagggctggggctaggtcagtgacaggaccagagtcagggcaagggccagagcagggcaaggccagggtagggccaggcatttcagggtcagggccatgggagaaccagggcaaggtctcaagcagggaagggccagggccaggacaggtccagggcagggtcatgacagggccaggggctgcattagggcaagggcagggccagagcaaggtaagggtcagggccaaggctagggtagggacagggcaagaaatatggcaggaccaggggcaatgccaaggccaaggctgagtcagggctgagtcagggcagggcagggcagggcatggtatggccagtgcaggacaggacaagagccggtccacagagagagcagggctgatgccaagaatgagccaggctagtgccaaggctgaggcagtgtcagagcatgtgcagggcagggccggggccagggccagaaccgagccagggcacagccaaggcagggtagggcggggaaatagcgtggccgggtcagtactgggacagggcagagcagggcaaggcgatggtaggggcagggcagagacaggccaatgcagagccatgttacaccggggccaggacacctccaagtccacttcagggccaaagctatggcaggacaaagaccagggccagggtcagagccaggtctgtgctgggcctagcgaagactagggtgagggccaaggcaaggccagggcagggtcaaaggcagagtagagccagggcagggtgatgacacatccagagcacagcagggcagggtgatggcaagaccaggggcagaccactgccagctcagggccagggaaagaccagtgcagagccaggaaagggtctgggtctgggtcagggccaggaacaaggcagagcagggccagggccatggcagagtcagggcaggtccttgacaggaccaggttccaggccagggccagggcagcagcaggggcagggcctggataagggcagggtcagggatatggcaggaccagggctagggccagggccaggccatagtgagggcagggcaaaagccaaggcagggtcagggcaggtccagggcaggtccaggaagcggccagcaccaagcggggccaaggcacaaccagcgcagggtaaggcagggcaatggcaccactgggccatgacagggccaggtcagtgccaggagagggcagaacaggaaggcccatggtggggccagggcagggatgggccaaagcagagccaggacatttccaaggccaggtcagggccagaacaggagcaggaccatgaccactggcagggccagtgccatgacaggaccagggtcaggacaaggggcagggccagagccagggccagagccaaggtcaggccagtgcaggttcagggcagggccagtgccagggcaagaccagggcagggacagggtagcacggggccaagacagggtcaggatgggaccagagcaggacagggctgagagtccaggtaacagtagggcaggtacagggcaaggcagggcagtacagggccagatccacggcaggcacagggcaaagccaggcccattgccaatgcaccagccctccctacaaggctcctaccacctggccactgctgcagcccgtccatcgctgtaagcctgactcccaaccctgcctgcagccgcccgccctcctagcgtggccactctcctaccgctctggcgcactgcagtctccgtcactgccacccacctgcagcgaggtgagccgtggtgttgcaggctctaggtgtctcctcctcctcctggcatggagcagctgggcgggcaaagccagaaaagcctagaggaagttgtgaagagtggaagcgttagagcctcaagttgtcatgccggccactgggtggcaggggccagtttcagcaaaggcactcacacccaccctccaaagtccagcctctccttttggcccaagctggccgggaactggggtctggggtgggtgctggagacaccacagcacccagctccccactccacaggaaccactgggcccaccggggctgcactcctcggggaacaggagaagcagaaaaattcagacccagccagccctccgcacccaggtgctaattcctgttccggatgcctccacacacagggccctgttccccgtggtgtccccaggggtgcctggcagcctctgaggcacagacccagagtgcacaggcccaggaaccacggtgggtgtgggggctctgccatgctcaggattcccatgcaaacgctgcgtgccctgccgcactccagtatgaccaagagtggttcgccctctggagtgtggagtcagggagaggagaaccactccttccttggatgccaactctgttgactgccgccagcagtgcagcccctgatagcaccgaactcgcccccgctccacggctagtcctgccctcaatagcgccccccacctccgtcccccaatgccgccagtagcatatacccgatatgccctaacctgtcctcctccatgggcattgcagccccagaaagcacccataacccaccctccctgctgtgggcagtgcagtcctgtgcagtgctaccaaccagtacccctaatgcaggcaatgacaccctggatagcgcccccaacccaccccacactgcgaaaggtgcagccctggatagcccctgtcctaccactctggtcatgctgcagtctctgtcactgccaccaccaactacagtgaggcaagccagtgggccgcaggctctagctcccagcagccaggcatggagcagctctcgctgatggccggctcctaccacactgaccatgctgctgtctgtctccgtggcaatcttctttcactacaaagaaataaaactaggtatcaataagaaaagtaattttggaaacaatacaatcacatggaagttaaacactaccctcctgaataaatgacctgaataaataaaggtcaatgaagatactaagacagaaattcaaaaatttcatgaaacaaagggtaatgaaaacacagtataccaaaacttgttacgcagaaagcagtacaaaggcagagatttacagctataagtgcctaccatccaaacaaaagaaaaacttcaaataaacaatacatcttaaagaactagtaaagtaagaacaaactaaaccgaaaataagaaaataaataagatcgtagcagaaacaaaattgaaataaaaaacacacaagattaaacgaaaagttggttttctggaaagctaaacaaaattgacaaacttttaaccagcctaagaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaatgaaaacatccaagaccagaacagattggtaacaagtaatgagattgaagccatcagaaaaagtctcccagtaaagaaaagcccaggaactgatgatgtcttcactgctgatggcttcacaccaaacaatttaaagacctagtacaaatcctgctcaaattattttgaaaaacaggagggaatacttccaaacttattctatgagaccattattactgtgatacgaaaatcagataaaagcatcaaagaagaaaactacaggacaggatctctaatattgatgcaaaaatcctcaacagaataccagtgaatcaaattcagtaatacattaaaaagataattcatcatgatcaactgggatgtatccctggaatgcaagagtcactcaacatacaatgtgatacatcatatcaaccaaataaacgacaaaaactgtatgatcatgtcaactgaaaccaaaaaagcatatgaaattcaacatcccttcatgctataaatcctcaaagaaacaggcacagaagaaacataccgcaacataataaaaactacaggaaagacacccacagctagaatcatatggaatggggaaaaatggaaagcttttcctctaagatctggaacatgataaggatgccccctgtcaccactgttgtttaacatagtaccagaaatcctagctaaagcaatcagtgcagcccctgatatggcccccaacccaccctgccccctaccaccagcagtgtcgcccccccccaatagcacacccaacataccctaacctccccgcctccccgcaccatgggcattatagcagcccatagcgccctcaacccaaaaccgccaccccccccccacagccacacagtgcagccccagatagcacacttaacccacctcactgttgccagcaatacagtctgggatagtgcccccaaccggctccccgccaaaggcagtgcagccccggtttgagcccccaaaccgcccccccccccgcccccgggcaggcagcacagccccagatagcacacccaaccagccacccaagacgggcagtgacgcctgagatagggctcccaacccgtcccaggccaccagcagtgcagcctggatggcgcacttaccccaatgcctttctacactggctggctgcagtgtccatcgctgccaccaaccacaaacatggctgcaaacaggaaggattttattcaccgtcgatgcggccccgagttgtcccaaagcgaggcagtgccccaaggtctatgcagagcagaacgcagctccgccctcgcaatgctctccgggtctgtgccgaggagaacgcagctccgcccttgcaaaggcacacagcgccggtgccggcgtggcggagaagcggacagcggcggagaggcggtcggcggcggcgcggcggagaggcggtcggcggcggcgcggcggagaggcggtcggcggcggcgcggcggagaggcggtcggcggcggggcggcggggcggcggagaggcggtcggcggcggcgcggcggagaggcggtcggcggcggcgcggcggaggcgaggcgggcggcggcggcgcggcggaggcgaggcgggcggcggcggcgaggcgggcggcggcggcgaggcgggcggcggcggcgaggcgggcggcggcggcgaggcggacggcggcggcgcggcggagaggcgcacagccgcggagaggcgcacagcggcggagaggcgcacagcggcggcgcaggcgcggagaggcgcaggcccaggctccactccccagctctgaaaactcatcctggtcagagttcagaaggacatgtggagtataaggtcagatgcggagataaagggagatggtgtggccctcctgcctgggggtgctgagcaggttgctggaggcggtgatctcactctgaaggagacagacacagaaatgtgtgtacagttgatggtgagcatctgagttgcgtcttgttagtgaggccaggagtgcctgtgtaagctggaacagattaggtatatgatttgtgaaacggagtttcatcctagatcttcatctagtcaaaggactgtttcctgattaggcattagcttagtggttgctagtctgtgttgacctttgaaaggcatgactaggctaactctgaagtttctgcttcacaccatttacaatttaaaattacctagagccttgtgggccattggaagagactgaatgtttcactctgaaatgggagtccttggagggttttgagcagaggagagacattcaggtaatcagatcactctgccaagacatcagtccggtagagatcagtccggtggcacaaaccagagggctagcagtggagatgagacaaagagtcaaacccggatagagtttatttggaagctgggtcagtaggatctcctggtggactgaatgtggggtgtgtgaggaaatgaggatggcgactggaagttcctggaaggatgggttgttgcaggttagataggaaactgtctgcagatgcagttttgggaagatgatgtttgtttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcctgcaggcacgcaggagtccagttgtacacggaggcgaaacactgttcagatcccgctgcagtgttaactatggtaaaggcagagttgaccaccggaggagtctttcagcgtggaggccttcagcgatcttggcaagcaccaattttcatggatgtaggagaatgggagcagaggaactggaggctgcaactgtggaaaacttttgtggggttttgctgcagagagaagcagagaaatgaagcagtttttggtggaagaagtggaatcaaaaggttttgagatgagagagagaacagagggaagagctgttggaataaagtccaggaagagtggatggtgtctagtgagcaagtgatgtgtggccctgagtagaggcatggacaaatcatctgtgcctgagctgcccgtagaactttctgtgatcatggagatgcacatctgtgcttcccaatattgtaacactggccacaggttgatatggaccacttccagtgtgactagtgtgattgaggaactgcattttaaatattatgtaattgtaattaattttaatttaaatagccacacatagctcctctatggggcaggtcagagctctgataaggctggatatgggaggaaaccctggtatagggttgaccgtagaggttcttttggttttggagtgaatcaggaaacagccatcagctgagtgaaggtgagggtggtggtgggtgtttgaagacaagggaaaagtgtgaaagaattatttggagaggaaggaaagaaagtgtggactggggatgtttccaatgtttgagcacgcagggctccacagttatctacatttgctgtcccttggagcaggagagaagaaaatggttgggacatattctgaacagactgtagaggtaaaatgtgtagggttttttttgttttttttgttttttgagatggaatctcgctctattgcccaggctggagtgcagtggcacgatcttgactcactgcaacctccgtctcccaggttcaagcgattctctcacctctgcctcctgagtagttgggactacaggcacgcaccaccatgcccagctgattttggtatttttagtagagacagggtttcaccatgttggcgaggctggtttcaaactcctgacctcatgtgatctgcccgcctcggcctcccaaagtgctggattacaggcatgagccactgtacccggccaaatgtgtagtatttttaataggataaagcctacataattctgtccacagttcctttacttagaaattgctcatttgttcatgttaatcctatgtttattacaaataacagcatacaggttccccccccccaccccatcatgtacagctgaatcacgtagaatttgaagatcaagatgatgaagccagagttcagtatgagggttttcgacctgggatgtatgtccgcgttgagattgaaaatgttccctgtgaatttgtgcagaactttgaccccctttaccccattatcctgggtggcttgggcaacagtgagggaaatgttggacatgtgcaggtgggtccctttgctgcgtatttggtgcctgaggctctgtggatttcccctccatcaatcatcttaccctctcatccccctcagatgcgtctgaagaaacatctctggtataagaaaatcctcaagtcccaagatccaatcatattttctgtagggtggaggaggtttcagaccatcctgctctattatatcgaagaccacaatggaagacaaaggcttctaaagtatacgccacagcatatccattgtggagccgccttttggggtaaaatatgattacaataacttgcctattgccgagattaaactttacaggctgtgttattttagctttgtgcttttcctttcataaaattccactcctaagatgtttctcttttctgggagcggggaggtggtttggagtatatatgtacatctatatccaaatctaagtgtccatatccagtatgttaaactagaatctaaaatttctggtttgctatatttctttttttccttttcctttaagaccctatcactccacagggaactggtttcttggcaatacagtctgtcagtggcataatggtaactatcttggatgatttcttttacagattggtttgagaaatatatcctgaatgtgggttattatgtacatgagactttaagttgaaaattactcatttttattaatataaagtaaatttccctttgcttttaatcttcgtacatccttttcagtagggtgtgggattagaggaggggaggtggaagaattataatggtacatttcctatttttatgcatcttttgcatttatttatccaagcaagtatttaagcagtgctcaccatgtgctaagcactatatgaggttatgaggagccgtcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagcctttttttttctttctttttttttttttttttttttgagaccgagtcacactctgtcttccaggctggagtgcagtggcacgatcttggctcgctgcaacctctgcctcctgggtttaagcggttctcctgcctcggcctcccgagtagctgggattacaggtatgcaccatcatgccgagctaatttttgtatttttagtagagacggaatttcgccatgttggccagactggtttcaaacttctgacctcaggtgatccacctgccttggcctcccaaagtgctgggattacaggtatgagccactgtgcctggcctcaagtcacccttgttagtttggcttaccaactttaaagttttggattgcttttgtcaaaccaatgggttgcaagttcagatggtctctcttgtttttcttaactaattgtaagtaaaattcactttggtaatttattgtgtcacatagaattgaagtttttctcttgctaatattattcctattttcaaattttggggctcctgttagcctgattttcagatagctgccacaggagttgtccttgatctggataaatccataaaaattgtgaagaaattaaagctaactggttttccatataaaattttcaagaacacttcatttattaaggtctgtatatctatatattctcatatttataaatgtccatattgtttgagaaaaggaatgaaatacctctaaaatgtgggcctcttatttttagaaaagtgtttgaaatcttttataaacttcatattttgtttgctcctttatattctgtattacttaaatatgctcaaaaaagcagtggtaaacagctatttaggaattgaggctgttactcctgacttccatgtgagactgccacagaactcatattgaaaatatgtcattttatccactaggttttgtttcctactttttaaattggtgttaagaaagggaaaaaaatcacaagtttgtctaactcagtagaaaaatcgacaaagcatttgcagacaacttggcaagggtacagagaaacggatgtactgtttttcagtattttgggagggtggtttgagcagcatttattgacaatttcattagtggggatgtttctattgaaaacagagttaggaagtcataaaatgttcttgcaatataaggtaataataccactggcgtttatcttactgttttcatgttctaagtgcatgcatctgagtaaaaggatctgggctgcagtccagtctgagagatgccagcaaaggcttcctaggccaattcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcacggatgtatgtttgaagtaagaagtaaagcataaagtatatgattttgtgtgtgtgtgtgtttttatcttgctatacctgtagggaatgtttaattctgccttggaagtggccaaatttgaagatgctgtgattcgaactgtcagtgggataagggggcagatcaagagagcactctgagctccagaaggagctttccaggatagctttgaggataagctgcggatgagcggtgagtgtcttaagtagtgttcagggcagggtgttaccattcatgcttgacttctagccagtgtgacgagaggctggagtcaggtctccagagagttgagcagctccagccttagatctcccagtcttatgcagtgtgcccatttgccttgtgtctgcagtcccctggccacacccagtaacagttctttgatctatgagaatagtttccttagcgagctttcccttcaaatactttgcagtcaggtagagaagtttggagtgaagattttgttctttgtttcttcacaatatggatatgaatcttcttttgaaaacgttaaagtaaattacctcttttcagatattgtcttcatgcgaacttggtatcctgtttccatcccagccttctataacccagtaacatctttgttgaaaccagtgggtgagaaagacacctggtcaggaatgtggaccacgggccaactcaggctcgcccatggtgtcagactaaagacaaacaaggactctctgtataaggtactggtcgtgtgtgtgttagtggagatgaagcctgtgctctacagacagggagtcacacagacacttttctataatttcttacatactttgaatgttcaagtataaagtctaatgttaaatttgattgaacaattgtatatttgtgggatattttggaatggaacaccaaaaaatggtaatagtggttctttctggattgaaggaaaacttttcttttttaaaataaattttattttatatatttgaggttgacaacatgatcttaaaggatacatatagatagtaaactggttactatagtgaagcaaattaacatagctaccatctcacatagttagatttttgtttgtgtgacaggaacagctaaaatctacttatttaacaaaaatcccaaagacaatatatttttattaactattgccctcatgatgtacactagatctctaacttgttcatcctacatgtctgctactttgtattattttaatgtacatctccccatttcctattggtcatttcctatttggcccatttttcaactgggttgtttttctgctcttaagttgtaagagttctttactgatttttggatattaacactttatcagatatgtggtttgcaaatatttcttccagtctgtaggttcccctttcattttgttggttgttcctttgctgtgcagaagctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgtgaaaatcctattattgaagagactatcttttttaccattgtgttgtcttgtttgcccttgtcaaaaattagttgacagtatatgtttggatttatttcaaaggtctctgttacgttccattggtctatttttttgtttttatgccagcaccatactgttttgattactatagctttgtaatgcaattttaaatcaagaggtgtgatgcctccaactttttctttcacagtgatctgttggctgtttggggttttttgtggttccatatgagtttcaggattgttttttcttttcttttcttttttttttttttttgaggtgaagtctcactctgtcacccaagctggagtgcagtggcataatctcggctcactaaaacctctgcctcctggattcaagcaattcttctgcctcagcctcccaggtagctgggactacaggcacatgccactatgcccggccaatttttgtagttttagtagagacagggtttcactatgttggccgggctggtctccaactcctgacctcatgatccacccgctgcagtctcccaaagtgctggaattacaggcgtgagccactgtgcctggccaggattgttttattctgttctgtgaagaatgtcatcagaactttgaggaggattgtgttaaatctgtatatttgctttgggtagtgtgaacattttaacaatattaattcttctgatccataaacataggatgtcttttcatttgttcatgtctaaatttctttcatcaatgttttatggtttttaagtgtacacatctctcaccttcttggttaaatttattcctaagtttttgtttttctttgatgctatcgtaaatgagattattttcttgattgcttcatcagctaggttatttgtatacagaaatgcaactgatttttatatgttgagtttataccttgcagcttaactgaattgatttagtagttctcacagttttttgtggactctttggagttttttacgtaaaggatcttgtcatctgcaaatagagataattttacttctttaatttagttgccttttttttctcatctgattgctcttgcaagtactctgttgaataaaagtgatgaggctggccatccctatcttgtactcaatcttagtggaaaagctttagttgttccccactaactatgattagactgtgggtttttcataaatggtgtttattatgttgaggaactttccttctatacataaactattaagaggttttatcaagaaatgttgctaaactttgttaaatgcttttactgcatcaattgaggtgaccatgtcattttatctttcattttgttaatgtgatgtatcacattgattgatttacatattttaaaccagccttgcatgccagggataaatcccacttaaacacgatgtataatgtttttgatgtgttgttgaattctatttgctaaaatttttttaggatgtttgcatcagtatttaatttattggagaagttgacctgtagtttttgttcggtgtgtgtgtgtgtgtgtgtgtgtgtgtgtgtgtgtgtgtgtgtgtgtgtgttttggtttggcttaggtattaaggtgatactggcctggtaaaatgtgtttggaattatttcctctcactctgtttttgcgaagagtttaagaagtaaactcccaggggatgggagtgactctggacatgggagtgacatgatagtgactctggaccctgcagtggtgggacacagcagcatctcagtctctgaaaggccaggcacagcatcagcaaggaccccagaatggtggagcactactgtggcttgagccctcgggggcagggaccagtacagcaactacttctctccctggggaggcaggtgcctgggcaactcagattctccagggctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagtgcttcagctctcatgcagtggggggtgtgactgcttagactggccaagacactgattccctggaaagcagggcaccaagtcagctcaggctccaaggggcagggcgcaatggcagctgggaggggaggggcacagcagcgtggccccgcaggtggggtgtatgctgtgatgtggacatcatttgttcccaccagccatttgaaatttcatccatttgaaatttgatttcaaatgtggtggtgtgggaggtggggcctagtgggagttatttgagtcacagggcagatcctttatgaatagattaatgccttttcatgggactggattagttaccaggagtggattgttatcagagtgagttcagcttcctagactcttgtgtttcctctcttgccatgtgagccccttgcatacacctgtttcgccttccactttccccatgagatgaagcagcacaagaccctcaccagttgtgctgcccgatctcggactttttagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggctgctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttattcctgcagggagacatcccctctgcttcaggctgatccctctgggggaatgggtggtgggggccagatgtttccttccctcctttatgtgaccgtcctgttttccgggctctactggatttctgctactccttgatgcactctggggctctcctttagtgactttcatcaaaatatagctgtttgctgctttggctgtctttgtcaggggatgagtgcaaggggctattgatcagcccttagctggcatcactccctcttaaacttttcactggatactcttttgaactgtttttttcccccaccatatacatgtattttttaaacgttaatgtgctaatttctactgaagcaatgtggatttttctgaaagctttaatgttttaataagctttttattgaaatgttaatgtacatacagaagagtgcccgaatcataagtgtgcatctagatgaactgtagcacaccaggctgccacgccctggaccaagcagtagccttgacctgtggcctctcccaggcactgctgccccaacccacaaaatagctactttcccagttcctgatgtagatttgttctgcctggttttgacttctataaaatacagcacattctatttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacagtaggtctgcatatgggacttgcaggtatgcaggggcacacccacttctgctggaggatccctgggtggggtggagactccagggcacctgtgctctgcttcagtgtggaggcttctgtgttgtgttctgggagcacagtggcttggcctccgccaccagcagcagcttgaagagttcctgctgttccacatggttgccaacaattggcctcttcagtttttttttttttttttaggttttcagtgcctgcctggacttgtgttttcatttagattttggtttcttagaactttcgttattctcttcacagcttaacaatgcatttgaaaagatttgttttcatgtggagtattcagttttgtaataggagggttgttcaaggcatcagtctgccactctgctagaaacagaattctcccaggcatttctttttatataaagtagttaatgaaattttgaaccatcttacatgaatttttattaaaatacacttcaggatgtggtgcccattatccattctactcttttgtaacaagtagatttctctgaattcttgaatttgaaaacaattggggttcctaaacagagaatatggaatattattggggatgatgtctttaataatacatctcaagataggagaaactttttctatatagttgactttaataaaagcctagggcaaaactttcaatatattaacagtatttatgaggcagttaagaatttgggtcatctctgtctccactaaaaatacaaaaagttagccaggtgtggtggcgggtgcctgtagtccctgctacttgggaggctgaggcaggagaatggtgtgaacccgggaggtggaggttgcagtgagccgagatcatgccactgcactttagcctgggcaacagagcgagactgcgtatcaaaaaaaaaaaaaaaaaaagaatttgggtcatctcaattaaacatagaatttaagattacattgaaaattcagtacagagtattttgccttcatctgttgtttgagtctcccttctttcagccatccttccatcagaaatagaataccaagttaaacttcttaattagaatcaggaatcaggactctttggctgctgattgaaggaagaactgtccttaaatccagagtgggccgggcatggtggctcatgcctgtaatcctagcactttgggaggccaaggcagatggatcacctgaggtcaggagttcaagagcagcatgaccaacatggtgaaaccccatctctactgaaaatacaaaaattagccgggcgtggtggtgtgtgcctatagtcccagatacttcggaggctgagataagagaattgcttgaacctgggaggtggaggttatgtgagccaagatcacgccactgcactctagcctgggtgacagggcgagactccatctcaaaaaaaaaaaaaaaaaatccagagtggttggtagtcaagacaaaaagctagattatttttgttagtctgggaactaaaaaaaatagttgtaactttgaagcctttttatggatcaacatgaagattgagggatctcaaacagaaagggcatcctggtggcaaaggttaatcattaccagactgcaagagtagtttcaatggcaagaaagcagcaacagaatcaatgaaaacaaagcaatgattagaatgccctttccccttctcctcctgacttgtagacactgattgtcttccttggacttagggaaccccttaggttcttgaaaaattcaatgatcaggctatagtagatggtccccagtacacagcacaagattttttgataaactggacattttgaaacccaaataactaattagaaaaatcaaacatgtgaaactactttatcccatgcataggggttatactggaaataaaatgtacaacattggaatcctgaaggagaaaagtcctaaaagtttcaatatcaagaatcctgcacctgctgctacttatctagccttttgcttgatttctggctgatgaacttgcacaactcttgaaaacttaaaaacttgaaaatttgtcacttgaaaactacttgaaccaaactatgaaatctcacctgatatataagatgcaattgttacaattattttaaacttcaatttactgttttgctctatcaaaagaaagtttcaactctgttagttgagtacacacatcgtaaacaagtttctgagaatgcttctgtctagtttttatgggaagatatttcctttttcaccttaggcctcaaagcgctccaaatgtccacttacagattctacaaaaggagtgtttcaaaactgctcaatcgaaattaaggttccactctgcgagatgaatgcacacatcacaaaaactttgtcagattgcttctgtctagttttgtgtgaagatatttccttttccaccacaggcctcaaagctctccaaatgtccacttgcagattctacaaaaggagtgtttcaaaactgctctatcgaaagttaagttcaactccatgagataaatggcaactccatgagataaatgacaaataagcttgtcagaatgcttctgcctagttttaatgtgaagatatttccttctccaccataggccgcaaagtgctccaaatgtccacttgcagattctacaaaatgagagttctcaaaactgctaaattaaaataaagtttcagctctgtgagaggaatgcacacatcacaaagcagtttcacagaatgcttccatctagttcttaaatgaagatacttccttttccaccataggccaaaaagcgctccaaatgtccacttgcagatattacaaaaagagcttttcaaaactgctcaatgtctgttcatgtccttcacccactttttgatggggttgtttgttcttttcttgtaaatttgtttgagttcattgtagattctggatattagccctttgtcagatgagtagcttgtgaaacttttctcccattttgttggttgcctgttcactctgatgatagtttcttttgctgtgcagaagccctttagtttaattagatcctatttgtcaatgttggcttttgttgccattgcttttggtgttttagacatgaagtccttgcccatgcctatgttctgaatggtaatgactcggttttcttctagggtttttatgcttttaagtcaaaagtttaagtctttaatccatcttgaattgatttttgtgtaaggtgtaaggaagggatccagtttcagctttgtacatatggctagccagttttcccagaaccatttattaaatagggaatcctttccccatttcttgtttttctcaggtttgtcaaagatcagatagttgtagatatgtggcattatttctgagggctctgttctgttccattgatctatatatctgttttggtaccagtaccatgctgttttggttactataaccttctagtatagtttgaagtcaggtagtgtgatgcctccagcgttgttcttttggcttaggattgacttggcgatgcgggctcttttttggttccatatgaactttaaagtatttttttccaattgtgtgaagaaagtcattggtagcttgatgggtatggcattgaatgtgtaaattaccttgggcagtatggccattttcacgatattgattcttcctacccaagagcatggaatgttcttccatttgtttgtatcctcttttatttccttgagcagtggtttgtagcacctccttgaagaggtccttcacatcccttgtaagttggattcctaggtattttattctctttgaagcaattgtgaatgggagttcactcatgatttggctctctgtttgtctgttgttggtgtataagaatgcttgtgatgtttgtacattgatttttaaggacatgaacagacatttctcaaaagaagacatttatgcagccaaaaaccacatgaaaaaatgctcaccatcactggccatcagataaatgcaaatcaaaaccacaatgagataccatctcacaccagttagaatggcaatcattaaaaagtcaggaaacaacacgtgctggagaggatgtggagaaataggaacacttttacactgtttgtgggactgtaaactagttcaaccactgtggaagtcagtgtggcaattcctcagggatctagaactagaaataccatttgacccagccatcccattactgggtatatacccaaaggactataaatcatgccgctataaagacacatgcacacgtatgtttattgcggcattattcacaatagcaaagacttggaaccaacccaaatgtccaacaatgatagactggattcagaaaatgtggcacatttacaccatggaatactatgcagccataaaaaatgatgagttcatgtcctttgtagggacatggatgaaattggaaatcatcattctcagcaaactatcgcaagaacaaaaaaccaaacactgcatattctcactcataggtgggaattgaacaatgagaacacatggacacaggaaggggaacatcacactctggggactgttgtggggtggggggaggggggagggatagcattgggagatattcctaatgctagatgacgagttagtgggtgcagtgcaccagcatggcacatgtatacatatgtaactaacctgcacattgtgctcatgtaccctaaaacttaaagtataataataataaataaataaataaaaactgctcaatgaaataaaggttcaactctgtgacatgaatgcacacatcaggaagaagtttctcagaatatttctgaatcatttttatgtgaagatatttccttttccaccattggcctcaaagcgctccaaatctgcacatgcagattctaaaaaaagagtgtttcaaagctgctcaatcaaaagaaaggttcaacactctgagatgaatgcacacgtcacaaagaagtttctcagaatgcttctgtctagtttttatgtgaagatatttccttttccaccattggcctcaaagcactccaaatgtcctcttgcatattctacaaaaagagtgtttcaaagctgctgaatcaaaagaaatgttcaactctgtgagatgaatgcacccatcacaaagaagtttctcagaatgcttctgtctagtttttatttgaagatatttccttttacaccataggcctcaaaacgctccaaatgtaaacatccagatcgtacaaaaaaagtttttccaaactgctccatcaaaataacggtttaactctgtgagatgaatgcacacatcacaaagaattttctctgaatgattctgtctagtttttacgtgaatatatttccttttccaccataggactctaagcgctccaaatgtccaattctagatgctacaaaaagagtgtttcaaagctgctgaatcaaaagaaaggttcaaatctgtgagatgaatgcatgcacacatcacaaagagtttctcaaaacacttctctctagtttttatatgaagatatttccttttcctccataggactctaagtactccaaatgtccaattctagacactacaaaaagagtgtttaaaaattgctcaatcgaaagtaagtttcaaccctgtgagatgaatgcacacatcacaaagaggtttttcagaatgtttctgtctagtttttatgtgaagatatttccttttccaccataggcctcaaagcgctccaaatgtccgcttgcagattctacgaaaagagtgtttcaaaactgctcaatcaaaagaaaggttcaactctgtgagatgaatgcacacatcacaaagaagtttctgagaatgcttctgtctagttcttaagtgaagatatttccttttccaccattggtcccaaagcactccaaatgtccacttccggattccacaaaaagagagtttccaaactactcaatcaaaaaaaggttcacctcagtgagatgaatgcacacatcacaaagaaatttgccagaatgcttctgtctagtctttatatgaagatatttccttttccaccataggccccaaagggctgcaaatgtccacttgcagatcctgcagaaagagtgtttcaaaactgctcaatcaaaagaaaggttcaactccgtgagatgaatgcacatttcacaaagaagtttctcagaattcttctgtcaggttcttaagtgtagatatttccttttccaacacaggactcaaagctctccaaatgtccccttgcagattctacaaaaagagtttccaaaccactctatcaaaagaaaatttcaacgctgtgagataaatgcacatatcacaaagaagattctcagaatgcttgggtctagttattatgtgaagatattaccttttcaacaataggcctcaaaatgctccaaatttccacatgcagattctacaaaaagagtgtttcaaagctgttcaatcaaaagaaagcttcaactctgtgagatgaatgctcacatcacaaagaaatttctcagaatgcttctgtccagtttttatgtgaagatatttccttttccagcataggcgtcaaaacgctccaaatgtccacttacagatcccacaaaaatagtgtttcaaaactgctcaatcaaaagaaaggttcacctctgtgagatgaatgcacacatcacaaataatattctcagaataattctgtctagtgtttatgtgcagatatttccttttccaccatagtcctcaaagcactccaaatgtccaattgcaaatcctacaaaaagagtgtttcaaaactgctcaatcgaaggtagggttcaactctgtgaggtgaattctcacatcaaaaaaagtctgtcagaatgcttctgtctagttttcatatgaagatgtttccttttccaccgtaggcctcaaagcactccaaatgtccacatgcgggttctataaaaagagtgtttccaaactgctcaagcaaaagaaatgttcaactctgtgatatgaaagcacacatcacaaagaagtttgtcagaatgcttctgtctagttttcatgtatagatgtttccttttccaccataggctgcaaagcgctccaaatgtctacttgcagattctacaaaaagattgtttcaaaactgctcaatgaaaagaaagtttcaactctgtgagatgaacgcacacatcacaaagaagtttctctgaatgcttctgtctagttcttaaatgaagatatttcctattccaccacaggactcaaagggctcctaatgtccacttgcagattctacaaaaagagtgtttaaacctgctcaatcaaaagaaatgttcaacccggtgagatgaatgcacacaacacaaaggattttctatgaatgattctgtctagtttttatgtgaacatatttccttttaagccataggcttcaaagcgcttcaaatgtacaattgcagattccacaaaaagagtttttcaaaactgctcaatggaaagaaaggttcaaatctgtgagaagaatgcacacataacaaagaagtttatcagaatgtttctgtatagtttttatgtgaaggtatttcgttttccaccataggcctcaaagagctccaaatgtccacatgcagattctacaaaaagagtgtttcaaagccgctcaatcaaaagaaaggttcaactctgtgagatgaatgcacaaatcacaaagaagtttgtcagaatgcttctgtctagtttttatgtgaagatatttccttttctaccataggctgcaaagcgcaccaaatgtccaaattcacattctacaaaaagagtctttcaaaactgttcaatcaaaagaaaggttcaactctgtgagatgaatccacacatctcagtgaagtttttcagaatgtttctgtatagtttttatgtgaagctatttccttttccaccattgcctcaaagcgccaaaaatgtccacttgcagatactacaaaaagagtgtttcaaagttgctcaatcaaaagaaagttgaaattctgtgagatgattgcatatattacatataagtttctcagaatgcttctgtctagttttgtgtgaagatatttccttttccaccacaggcctcaaagctctccaaatgtccacttgcagattctacaaaaagagtgtttcaaaactgctcaatcgaaagtaaggttcaactctttgagatgaatgcacccatcacaaataagcttgtcagaatgcttttgtctagtttgtatgtgaagatatttccttttccaccgtcggctgcaaagcactccaaatgtccacttgcaatttctagaaaaagagtttttcaaaaccgctcaattaaaataaagtttcagctctgtgagaggaatgcacacatcacaaagcagtttcacagaatgcttccgtctacttcttaaatgaagatatttccttttccaccataggcccaaatgcgctccaaatgtccacttgcagattctacaaaaagagagtttctaagctactcaatcaaaagaaaggttcaactctgtgagatgaatgcacacatcacaaagaagttactcagaatgcttctgtctacttcttaagtgaagatattaccttttccaccttaggccccaaagcactcctaatgtgctcttgcagatcctacaaaaagagaatttccaaactactcaaccaaaagaaaggttcaactctgttagatgaatgcacacatcacaaagtaattggtcagaatgcttctgtctagtttttatgtgaacatatttccttttcaaccataggcctcaaatcgcttcaaatgtacaattgcacattccacaaaaagagtttttcaaaactgctcaatgaacagaaaggttcaactctatgagatgaatgcacacatcactaagaagtttgtaagaatgtttctgtatagtttttatatgaagatatttccttttccactataggcctcaaagcgctccaaatgtccacatgcagattctacaaaaagagtgtttcaaagctgctcaatcagaagaaatgctcaaggctatgagatgaatgcatacatcacaaagaagtttctcagaattcttctgtctagtttttatgtgaagatatttccttttccactataggccacaaagttctccatatgtccacttgcagattctacaaaaagagtgtttccaaactgctcaatcaaaagaaaggttctactctgtgagatgaactcacacaccacaaagaaatttctgagaattcttccgtctagtttttatgtgaagatgtttccttttccaccataggcctcaaagagctcaaaatgtccagttgctgattctacaaaaagagagtttcaaaagtgctccatcacaggaaatgtttaactctgtgagatgtatgcacacatcaaaaagaagtttctcagattgcttctgtctagtttttatgtgaagatatctccatttccaccataggcctcaaagcactccaaatgtccacttgcagatagtacaaaaagggagtttcaaaacggctcaattaaaagtaaggttcaacactgtgaggtgaatacacatatcacaaagaagtttatcagaatgcttctgtctagtttttatgtgaagatatttccttctctgccattggcctcaatgcgctccaaatgtccacttgcagattctacaaaaagagagtttccaaactagaaaatcaaaagaaagtttcaactctgtgagatgaatgcactcatcacaaagaagtttctcacaatacttctgcatagttgttacatgaagatattttgttttccattacactcctcaaagcgctccaaatgtccacttgcagattctacaaaaaaagcatttcaaagctgctcaatcaaaagaaaggttcaactctgtgaaaagaatgcacacatcacaaagaagtttctcagaatgtttctgtctacttcttatgtgaagatatttccttttccaccataggcctcaaagtgatccaaatgtccacttgcagatccttcaaaaagatttccaaactagtcaatcaaaagaaagtttcaactctgtgagatgaatgcacatataacaaagacatttctaagaatccttctgtctagtttttatgtaaagatatatacttttacaccataggcatcaacgcactccaaatgtccacttgtacctagtacaaaaaggatgtttcaaacctgctcaatcaacagtaaggttcaactctgtcagatgaatgcacacatcacaaagtattttctcagaatgattctttgcagttcttaagtgaagatatttccttttccaccagaggcctcagagccctccaaatgtccacttgcagatactgcaaaaagagtgtttccaaactgttcaatcaaaagaaaggttcaaatctttgagatgaatatacacatcatgaagaagtttctcagaatgtttctgtccatgttttatgagcagatatttccttttccaccatagacctcaaagcacaccaagtgtccacttgtagattctacaaaaagagtgtttcaaaactgctcattgaaaagaaatgttcaactatgtgagatgaatgcacacaccacaaagaagtttctcagaatgttctgtctagttcttaagtgaagatatttccttttacaccataagcctcaaagtgctccaaatgtccactggcagattgtacaaaaacagtgtttcaaaactgctcaatggaaagaaaggttcaattctgtgagatgaatgcaaacaacacaaagaagtttgtcagcatgcttctgtctagtttttatgtgaagatatttcctttaccaccatatgccacaaagtgctccaaatgtccctttgcagattctacaaaaagagtgtttcaaactgctcaatcaaaagaaagttcaactctgtgagatgcatgcacacatcccaaaaaaatttcccagaataattctgtgtagtttttctgtgaagatatttccttttccaccgtaggcctcaaagaattccaaatgtccacttgcagattctaccaaaagagtgtttcaaaatagattaatgaaaagaaatgttcaactctgtgacatgaaagcacgcattccaaagaagtttgtgacaatgcttctgtctagtttttatgtgaagatatttccttttctgccataggcctcaaagtgctcctaatgtccacttgcagattctacaaaagagtgtttcaaagctgctcaatcaaaagaaagtttcaactccatgagatgaatgcacacatcacaaagaagtttctgagaatgctgctgtcttgttgttatgtgaagatatttccttttccataattggctgcaaagcgctccaaatgtccacttgcagattctacaaaaagagtgtttcaaaactgctcaatcaaaagaaaggttcaactctgtgagatgaatgcacacatcacaaagaagtttctcagaatgttctgtctagttcttaagtgaagatatttccttttccaccataggcctcaaagcactccaaatgtccacttgcagattgtacaaaaacagtgtttcaaaactgctcaatggaaagaaacgttcaattctgtgagatgaatgcaaacaacacaaagaagtttgtcagcatgcttctgtatagtttttatgtgaaaatatttccttttctaccataggcctcaaggcgctccaaaggtccacatgcagatcctacaaaaataatgtttcaaaggtgctcaatcaaaagaaatgttcaactctgtgagatgactgcacccatcacgaagaagtttctcagaatgcttctgtctagatcttaagtgaagatatttccttttccaccataggcctcaaagcgaacaaaatgtccgcttgcagattctacaaaaagagtgtttccaaactgctcaaccaaaagtaagattcaactctgtgggttgaatgaaaacatcacaaagaagtttctcaggatgcttctgtctagttcttatgtgaggatatttccttttccaccgtaggcctaaaagtgctccaaatatcaacttgcagattctacaaaaagtgggcttcaaaacttctcaatcaaaagtaaggttcaattccctgagatgaatgcacacatcacaaagaagtttgtcagaattcttctgtctaatatttaagtgaagatacttccttttccaccatatgccgcaaagcgctccaaatatccacttgcagattctacaaaaagagtgtttcaaaactgctcaatcaaaagaaagttcaactctgtgagatgaatgcccacatcacaaagaaatttctcagaatatttctgtctagcttctctatgaagatatttccttttccaccataggcctcaaagtgttccaaatgtccacttgcagattctacaaaaagagtgtttcaaagctgctcaatcaaaagaaatgttcaactctgtgagattaatgcatacatcacaaacaactttctcagaatgcttctgtctagttattatgtgaagatatttcatttttcaccttaggcctcaaatcactccaaatgtccacttgcagatgttacagaaagagtgattgaaaactacacaatcgaaggaaaggttcaactctctgagatgaatgcacacatcacaaagaatttgtcagaatgcttctgtctaatatttatgggaagatatttccttttccaccataggcctcaaagcgctcaaaatgtccacttgcagatgctacaaaaggagagcttccaaactattcactcaaaagaaatgatcaactctgtgagatgaatgcatacatcacaaagtaatttgtcagaatgcttctgtctaatttttatgtgaacatatttccttttccactgtaggtctcaagccacacaaaatgtccatttgcagatagtaccaaaagggtttttcagaactgcttaatcaaaagtaaggttcaactctgtgagatgaatgcacatatcgcaaataggtttgtcagaatgcttccacctagtttttttgtgaagatatatccttttccacctcaggcctcaaagagctccgcatgtccccttacagattctacaaaaagagtgtttccaaactgctcaatcaaaagaaatgttcaactctgtgagatgaatgcacacatcacaaagaagtttctcagaatgcttctgtgtagtttttaggtgaagatatttccctttccaccataggccccaaagcgctccaaatatccacttgcagatactacaaaaagtgtttttcaaaactgctgaatccaaagaaatgttcaactttgtgagatgaatgcacacatcagaaagaagttacacagactgcttctgtgttgtttttaggtgaagatatttcagtttccaccataggtcttgaagccctccaaatatccacttgctcattccacaaaaagtgtgcttcaaatctgctcaatcaaaagaaagtttcaattctgtgagatgaatgcacacatcacaaagtagtttctcagaatgcttctgtccagtttttatgtgaagatatttccttctccaccatagaccttaaggcgttccaaatatccacttgcagattttacaaaaagagtgtttcaaactgctcaatcaaaagaaaggttcaactctgtgtgttgaatgcacaaatcacaaagaagtttctcagaatgcttctgtgtagtttttatgtgaagatgtttccttttaccaccattggccacaaagcgctccaaatatccacttgcagattctacaaaaagtgtttcaaaactgctcaatcaaaagaaaggttcatctctgagacatgaatgcacacatcacaaaggagtttctcagaaggcttctgtctagtttttatgtgaagatatttctgtttccactataggccgcaaagcactccaaatatccacttgcagattctacaaaaagagattttccaaactcctcaatcaaaagaaagtttaaactctgtgagttgaatgcacacatcacaaagaagtttctcagaatgcttctgtctagtttttaattgaagatacttccttttccaccattgagctcaaagcactccaagtatccacttgcagattctacaaaaagagtgtttcaaaactgctcaatcaaaacaaagtttcaactctgtgagatgaatgcacacatcacagagaagtttctcagaatgcttctgtctagtatttatgtgaagatatttcctcttctacaataggtctcaaaccactccaaatatccacttgcaaatactacaaaaagattgtttcaaaactgctcaatcaaaagaaatcttcaactatgtgagttgaatgcacacatcacaaagaactttctcagaacgcttctgtgtagtttttatttgaagatatttccttttccaccacaggccccaaactgatccaaatatccacatgcagatccttcaaaagaagtgtttcaaaactgttcgatcaaaagaaaggttcaattctgtgagatgaatgcacacatcacaaagaagtttctcagaaggcatttgtgtagtttttatgtgaagatgtttccttttcctccataggcctcaaatcgctcccaatgtccacttgcagattctacaaaaagagtgtttcaaagctgctcaatcaaaagaaatgttcagctctgtgagatgaatgcacacatcacaaagaagtttctcagaatgcttctgtctagtttttaagagaagatatttccctttcctctagaggtcccaaagtcctccaactttgcagatactacaaaaagagtgtttcaaaactgctcaatcaaaagaatatttcaactctgtgagttgaatgcacacatcacaaagaagtttctcagaatgtttctgtctagtttttatgtgaagatatttccttttccaccataggccccaaagcactcaaaatatccacttgcagattctacaaaaacagtgtttcagaactgctcaatcaagagaaacattcaactctgtgagatgaatgcatagatcacagaggagtttctcaaaatgcttctgtctggttttgatgtgaagatatttacttttccaccatagaatgtaaagcgctccaaatatccacttgcagacactacaaaaagagtatttcaaaagtgctaaatcaaaagaaaagttcaactctgtgaggtgaatgcacacatcacaaagaagtttctcagaatgcttctttcttgtctttatgtgaagatatttccttttccattcagaacctcgtagcagtgttctgtaatcctgtgtgagggacaaacactcagaatccagccactgtgtactggaatcctatctgagggcacacatttaaaatccagatgtagtctccttgctttagtgaatacacttacctccttttcctgctatacatttaggcaaattatttttctgtatcttaaataaatggtaaatacctgaaatttcttactttttccaggcagagtgtcttcactatgtagctgtagaagtataactatttttgtctgtgtcacaattttgtactcaggaaccctggccatgtcactagccaaatggacataacttatggaatacatggacagcatccggttgatatgctctagagaaaaatagcagctaccatagacttcaggaaagacacatcgagccaatgacaaaaatgtgggtttcctaccttcagggagtctaagaatgcagtagaaagtgatgtggagcaaacatctttcaaatggaaggaagggatagggaaaggaagactgttagaggctcttttgaatgttagaggcaacataaaacatatttggatgtgtattctaaataaaatgcaaatgtcaagaaggatgtcagctgtgagtgggactcagagaaagagaaacgttttggactacagaggcctgcagtacaagtggatctacaattttgtttagggaatccaatgcctcaggtatctatgagaggcagaattttcctatggagccagcggcaaggctccagaggagaaatacagtacaagccactttattttggagtaaaagccttttgtacaaaaattacccgccccctccttttttgagaaacaatttcacattgggatactaataagaaggaatgctcagtcatgaataagggtgaccccgttgtgatctgagcattataggatcatagtaactacaaccagtcttccatcattccatggaaattgcatgtatgccacgttgccttctcagtttccaagggaccaattaatgaacaggctactcacattttcagcatcctactcctgacacactcccacccttctttctatttatctgtgattcatagagatttgcctatgactggattcctgaggagaaaaaagtctggattacagatggcattccttgttatggaaggcccttccttctgaaagtctatttctatcatgttctttccctgtgctgtcaaagggtcacccctttgtacaaaggagaagagaaatccatcaagtaaataaaatttcatttacctttgtaaaaaatatttctaccaattcacgtggaggaccttatggtttggtccgataatcagagatttgaaagaacctgatattgttggccagcagattagaaaagagttattagagagagatggctcaagtgataataactgtgtgccttgtgaatgctcacctaaaccaaagatcactgaagataatgtattttaccataatgttttaatctcaggtaaatgccaattaggagacaaacacttgtttatctcctgattggtattgatctgaattaagctgtctgccatttggagaaatttaaatgctattttaaacacacagtcttgttacttgagttatttatgatcttaagcggctcccccccttttgtgggttagattgtgtcttcaaaaagaaaatatatatattagagttctagcccctgatgtctgtgagtatgacttaatttgaaatcaaattatttgcagatgctgtataattatgatatgctagatgagctcataatgcattagagtgggccataattcaatatggttgatatcctcataagaagggaagaggaaacagagacgcagggaggagatggcaatgtgaggatggaggtagagaataaagtgaggtatcctccagccaagcaatgacaatgaagctcagtgatcacccggtgctagaagaagcaagaaaggatttttttccaggtcattcagagaaaaatgcagcactgctaactccttcatttaagatttctagctttctgaaccgtaaaagaataactttatctcattttaagcgacctaatgtgaaccactttgtcacagcagatataggaaattacacctccttaaagaatgcagaatcctggcccgtgcttgcctcatacctattgaatgagaatctaagggctctagaatctgcattttgaaactaatacataatacacaaagagaactcactaagtactctacatgcacttcatcctcacaagccatgaagtagtttactattataattctcattttacatatgggaaactggagcatgaaaagattaagtaatttgcctacagtcactcacataaccagaaagtggaagagctgggattcaatcccagttccagacatcctgatatcctggtttcagacaccacacacttagcaactattacacacttagcattattattattattattattattattattattattattattttaatcaccatctccaccttcttaagcactcaaaagttgaaatccagtggtgtgttgctgtttccattcatagcaagttatagccaaaatcataaattacacttcctccaaaacagtatactgacttctcatctctttttaaaatcccttccgtcgttcttttctttcttctcttctcttttcttttctcttttctttctcttgctctgtcacccaggctggagtgcagtggcatcatctcggctcactgcgacctccacctcctgggttcaagcgattctcctgtctcagcctcccaagtagctaggattacaggtgcccaacaccatgcccgtttaatttttgtatttttagtagagatggggtttcacatcttggccaggctggtcttgaactgctgacgtcgtgatccatccacctcggcctcccaaagtgctgggattacaggcatgagccactgtgcccagcctctttcacccattgaaatctcatttcaacaattaccatcttttttgagtggtatttttgaagttataaatgaattccctataatacatagtgagaatatttatgggagcttcctaattgactttctaaacattctgcattgcttctcatttccttctttaaatttccttctaccttgacttccttaagaccactcaatgttggccccatgctttcatttttttcttttttcttttttttttttttttgagatgaagtttccctcttttcacccaggctggagtgcaacagtgtgatctcagctcactgcaacctccgcctcccagtttcaagagactctcctgcctcagcctcccgagtagctgcgattacaagcatgtgccaccatgcccagctaattttgtatttttactagagatggggtttcttcatgttggtcaggctggtctcaaactcccaacctcaggtgatccgcccgcctcggcctcccaaagtgccgggattataggcatgagccacaatgcccagcccatgctttctttttaataactccttgctgcctagttttttcatgtccactgtgtaactactagtcttaatgggtatttcttttcttactattctgcaccaatgtttccctgattgacaacagttttcctgaaatgtattcttggaatggaattgtatgatacgcttagaaaattctgcataccttatacttcagaatgtgtatgtaaaagactccagtaaatgatccagggaagcaaaaatatttgtgtgttttgcgagttgtattcatatgtgtataaaattcccacagcactttgggtaacaatgctctgcacacttttcctgtgctccttttatccattcccacacttccagcatttcctttgacgtttgattttctttatttttttttactccaatattttcctgtaggtttcaaacctgtattttaaaatatcaactgattctctccctctgtcttcaccacctgcatctcaaatttgacatagccataaacacattttatattttggcaaataaatctatttcttttaaagcattgcccatctcagctaatgatgataatatcaagccagtcgccaagaaaatttagagtatttataccttgactcttccttctaaatgaattattaagttcagctgtttctaccttgaattacctttctattctgccatttctcttctgtgttgctgctaatgttttaatttagttattcatcacatcatgcctgtactgctggaataatcttgactattctttctgactttttcttctaactgcatctcaaaaacttctatctagaatgaaaataagtatatatatatatactatatatacatatatacatatacactatatgtatgtatatagtataagtatagacatgctatatactatatatactatatatttatatacacacacacccactatgcttttaaaaattgtttacttatgtcccatcattgaagggtaaaatacaaaatcactgatattgagagacattctcctcaatcatttaacattttccttcacaaacctgtgctgtagccacacccagaacaggttatgttccttcaaagacacacacacttttctatcactctccttttactccttctattccatctgcttagaccattttttacttgttttctgtctatctccattcatttttcaggatccaattaaaatattgatacaaaggctgagatctttatatcttctcttatttaaattcctggaacaccagataacttcctctattataattcttactgtatacaaccataactctcatttgaaaacaatgaatacataattataaaatcagatatatcataaaatgattggtatcaatatgtgaaaaaaaatctttaatgttgaaagtacaagattacaagccatctgaaagtaactgaacatcaatcagagaaaaatgctcatcattttttgatgaaaccaaaagtaagagaatttggtattaatctactacatcattggtaaattacatattaattattgtgagaaagaaataattgacggaatttaaagaaaatcggttttcctttatttttattattctacctaaaaatattatatctaattaaaatcatgattttaaaattatcccatcaagtatgtcatcacactaaaatccattgtatttaatttctcaactgagaaattgtattcaattgtattcattttccctactgaaaaattaatataaaagcaatcacatagcattcagaaattaataaatatttaaagaaattaaacagcattagattttcttgttgtaaaatttttttcttctctcagtatggcttatgtctctgcttctattgaacatagcacaattcaagtattaatacagcacctttataaaagttgtgaatctcagaaatgaacaagcttacctccttagttatttattaaaagttacaagtcacttttttttaacttcctaataatcttagaggggtatattttgtgtttttgtttgctatatctttcataaagaagatccctaatgatttgaaagttagaaccaattttctgaaggattgagccacgctccttgaagttgtgtgtttgtgggtggcacactatgtcttttgcagacccggaacctaccccttgatctagaacatattttcctccacctgccttttaagtttttatttcagcaggagtgggtggtttgtggttgaccgaaaatagaacgggctacaaaagcccttcctgtttgatattgaatctgctatttgagtcacccttacattatgaactgactgttaattaacacatttggtaagagaatatcctgatctgctttgcatgtgaggctctcccagtaataaacaaagaagcataatcaaacaagattttaatttctctatgccctgttagaaattcagatataattcaagtcatcttggaaattttaagttgcattctgatgtcgtctctgttctggccattgtgcaatgggccttcaaatgttgtagtagaggccaactgatattccattgttattcatttatacacaggtacatatatggtgtgtgtacgcaaatatataaatattcatatatgtgtacatgtgtacatacatacatatggaggtaatacaagtttgcattgtttttaaaattattttacccaaattaacaatgactctattgcatatctttattggttatatcacatttatataaataaatttatatcagtgacaatttccaagtaagtgaaatttgaattggattcagggttttatttttttgaaatttctgattaaaattacttgattttttaaattttatcttaaaatattcaagtcccatttgtaaaaaaaaaatagaggattaaaatgaagtgtgtctttatgagtcacaaatttttattttactttactaattgttaaaataatattttttccatgaggcattttataatgccctctttatttttttggtgatgtatttttttattattattattatactttaagttttagggtacatgtgcacaatgtgcaggttagttacatatgtatacatgtgccatgctggtgcactgcacccactaactcgtcatctagcattaggaatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttgctgagaatgatgatttccaatttcatccatgtccctacaaaggacatgaactcatcattttttatggctgcatagtattccatggtgtaaatgtgccacattttctgaatccagtctatcattgttggacatttgggttggttccaagtctttgctattgtgaataatgccacaataaacatacgtatgcatgtgtctttatagcggcatgatttatagtcctttgggcatatagccagtaatgggatggctgggtcaaagggtatttctagttctagatccctgaggaattgccacactgacttccacagtggttgaactagtttacagtcccaccaacagtgtaaaagtgttcctatttctccacatcctctccagtacctgttgtttcctgactttttaatgattgccattctaactggtgtgagatggtatctcattgtggttttgatttgcatttatctgatggccagtgatggtgagcattttttcatgtgttttttggctgcataaatgtcttcttttgagaagtgtctgttcatgtccttcgcccactttttgatggggttgtttgtttttttcttgtcaatttgtttgagttcattgtagattctagatattagtcctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggttgaacttttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtacctgtaccatgctgttttggttactgtagccttgtagtatagtttgaagtcaggtagtgtgatgcctccagcgttgttgttttggcttaggattgacttggtgatgtgggctcttttttggttccatatgaactttaaagtagttttttccaattctgtgaagaaagtcattggtagcttgatgggtatggcattgaatgtgtaaattaccttgggcagtatggcctttttcacgagattgattcttcctacccatgagcatggaatgttcttccatttgtttgtatcctcttttatttccttgagcagtggtttgcagttctgcttgaagaggtccttcacatcccttgtaagttggattcctaggtattttattctctttgaagcaattgtgaatgggaattcactcatgatttggctctctgtttgtttgttgttggtgtataagaatgcttgtgatttttgtacattgattttgtatcctgagactttgctgaagttgctcatcagcttaaggagattttgggctgagacaatgggattttctagatatacaatcatgtcttctgcaaacagggacaatttgacttcctcttttcctaattgaataccctttatttccttctcctgcctgattgccctggccagaacttccattactatgttgaataagagtggtaagagaggacatccctgtcttgtgccagttttcaaagggaatgcttccagtttttgcccattcagtatgatattggctgtgggtttgtcatagatagctcttattattttgaaatatgtcccatcaatacctaacttattgagagtttttagcatgaagggttgttgaattttctcaaaggccttttctgcatccattgagataatcatgtggtttttgtctttggttctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaatgaaaatcaatatatatcataacagctctgtaaatgtttctctgagttctgtgagccatcctaggaacttaattgaacccagggagggggctcatgcgaaccctttttttttttttttttttttttgagatggggtctcattctgtctcccaggctggagtgcagttgcaggatctcaactcactgcaacctctgcctcccaggttcaagcgattctcctgccttagcctccctggtagctgggcttataggagcccgccaccacacccagctaatttttgtattttatttcatttatttatttttttgagatggagcatcgctctctcacccaggctggagtgcagtgacatgatctctgctcactgcaagctccacctcatgggttcaggccattctcctgcctcagccttccaagtagctgggactacaggcgtccgccaccatgcctggctaatttttatttgtatttttagtagagatggggtttcaccgtgttagccaggatggtcttgatctgacctcgtgatccgcctgccccggcctcccaaagtgctgggattactggtgtgagccaccgtgcccagtttaatttttgtatttttaatagagacggggtttcaccatgttggccaggctggtctcaaacccctgatctcaagtgatccacccgccttggtctcccaaagtgctgggattacaggcgtgaaccaccatgaccggccgtggatgtagtttttagccaggcagtcagaagtatgcgtcgcctggacttggaattagtgcctgaagtggggctggtctcatgggatcgagccgtcaatctgtgggattggacactatctgcaggtagacagtgtcaggattgaattgaataagaggacacccagttggtctctgtgagaaatgtttggtgtgtaaggaaaagcccccacacagccagccacagaagtgtgctattgttgagtgtgagagtacaagggaaaaacagtttgcttttttgctttacagtgggatatttgatccataggtctatatctaagcacatgaatagaatgtgtttgggcctggttttttagtcttgctggtcagtaactagtttgacaagagagactagcacactgatcccaaaagaactaggccaagagcagataggatttgtggaaacttgaacctcttattagctccttaaaagacgtacttttctagacttctttggagcctgggattctagtactggtgagtttccaccggcagcagactccctgaagatttgctagccctctgcagggttggcaggccactaccacatttagttggctcctagggtatgttccacaccagacttcccattgtgggaaggccaagagaactgaagagacagtctctactctggaggtggggaagtgggggaggtggtaatttaattaacagtaggtggtgggtgaggcgacttggtaaggtaagaggacacacaaaggaagtaactgcagtaaaccttagctggcagcacaagtgaggaggtgtgcttgaaagagaaatggagtgtctggaagtgggtgagtatattctggtaggtgtgacaaaggcactgttcctccaacaccagtcctgggaaaggcatatgatatggtttggcgctgtgtccccagccaaatctcatgatgaattatgagcttcagtgttggaggaggggcctggtgggaggtgactggatcatgggggtgaatttcccccttgttgttctcgtgctagtgagttctgagatctggttgtttaaaagtgtgtggcactgccccttcactctctctcctgccgccatgtgaatatgtacttgcttcccctttgccttccccatgattgtaagtttcctgaggcctccccagccatgcctcttgtatagcctgcaaaactgagtcaattaaaccttgtttctttataaactatccactctcaagtagttctttacagcagtgtgagaacagactaatacaacatgggatcccaagtaactatgcattcagagaagaaacacaggtatgtttgggaactggatgatggaaggtacagggaagcactgtaggtaactttcatgggtcctacactctacaacatattcttggggttggaatgagtcaaacaggagactgatgtccaggatggaattggctgtttatgttcccaggtgtaggtctcttccttaacagatcacggtagcttcattacaaatggcctgggaagcgtacataatgcagaaaccccagcaaattcttacaggggttagtcatgcagttatacattttcattctgggatttctaggggcttaataaaattccttcattggatcatttaatccaacataaattatttccctacacctactttatacttgctccctgatttcataccagtgagtatagcctgatgtaactaaacattctgaattttcagtgatacccagagaagagtgtgataaccaattctctcaaaagcgatttactgcaaatattttcatttacagtaagtccttacttaacattgtggatatgttcttggaaacagtgactttaagccaaacgaggtactgtgtggcttcataactcaactctttttcctatcaattagactatgggaaaactggtttcgtatgcattatgtccttttgcttaaagtggtagtttccaagaacctatcaatgacattaagtgaggacttattgtaatctgatatctgcgggtggataatttaaggaacacatgcatagttaagcctgtaaactgctgcaagttccagatattatcagttctatttctccacaattacaattccagttttggggtttctttttgctcattaaatttgaaaagccaattccagttttaaagcttgacccttttcttataactttttttataactgataatatatcagttatatcagttatatttcttaggcttcccacgaaaccctcaaactgactctgagggtggccttgctatctaatttacaaaaccggttatcttggtttgtgttcattttatttcccttgcatacattgcttagctgcttctgattatatgcctcttagccgcggctggatagaaaagtgtaataagagaaaagtgtaactaagagacacagaagaaagagaaattccatgagcaccagatacttttatgggtgccttttggaagctctaaattgagatgtatctttgttgtcaatttatgctatgaatccaaacgaaaaatggggggagaaaaacaaataggctgtagatgaaagtggaagaagaaaaatgagtctatatatatatatatattagcagttgtatgaaagtatatgagtcaatattccatcaatacctagaaaaatagtagatcaatatgctgattttaggggtggacacaaaagtgttataagtgtcttttaacttttcttttttccctccttgactctgaagagaaacaccattttttctacgtatgcaaagagtaaaaattcagaactaacatgcagggattaatagcagtgaattgcaaactcaactcagtggtatagtacctggcaacattattactcagcatatttccctggctgaggctgacttcatttaaagtagttttatacttgtgctaaaaataagtgtacatcccattaagggagaaaagatcttctacacaatggattggacctacataaccttatgtaccagagaagaaaacatcattctcatgagtcgcaaagctttcttcttcttgtcaatatgataaacagtttccgtaaattgagaatgacgctggttactttccttcctcctgaacatgccacactgaagagacagggatgactccttccctatgggacagacacacatgtagctttccctgggttgtggaggaaggcatggccacaacaccattggcagtctgctgcagggacctcacgatgagaggaagcaatggatgcctgggccagggaaatgcatatttgggagaaagcaggaaattctgatgtagagatagggaagaaccctggggaaaaggacccaagctgggcggggaggaggaaaccaccaggatcccaggatcagagacaaaggacccagggacacaaacaaagtgaggccagatggagagggcaggctcacggggagagcaagctcacagggagagcatgagccaaacctggcttatttcacactcatcagagagactgcacagatggggccaaaccagggcccaggagcatcggagagaggagggccatttcaaagacttttgtaaaataagctcaaagtttctttgtttatttgtgggtgtgggagtggaaacgtagggaaagtgaagaaagtgggggaaaagggatgggtgattttgtaggcaagatgctccctgaggaggtcctggtggacctgctgtggggcgtggcattctgcacactctcatatcatggggagcgcatgactacattactgcttacacatctccaagtgcagcttggggggtgaatgtttaattgtctcactgtaactgtctaaatctctggaaaatgtgaagggtcatgcatttgatttaaacctatgaggtctgaatgaattctcctccatgcctaaccgagtgaagcaagtatataaccaaccatgcatccctaagcagggccggtatgaaagggaggaaacgcctccccactgagctcgcaaagaacttcatcactgacctgaatcagatccagcaggaaatgaaacactgagtacatacttttacagtagagggagggggacggaaaacaaagtgagctgaactgaaacgtgagaaagaacagaatggcagtgagtccacggggcagggccgcagctttcttttttcatggccctcagtccagtaaccccacccggcattcgtagcggatgacatcattgatgcccaaacatgctccagcaatttcctgctttccagagtccagccgagccatgatgtcagtggtgcacctgggtaaagatatggcagggccgggtcacagggagtggggacaaaggccaacccagttaaataaactgctggtcttctagggcctggtccctaggcaggcttccaccatgagataggtatagcccaggccaatcccaacaagaggaaaaaaagcatgtacttggccgggggcggtggctcacacctgtaatcccagcacgttgggaggttgaggcgggtgaatcacgaggtcaggagtttgagaccagcctgaacaatgtggtgaaaccccgtctctactaaaattggaaaaaattagctgggcgtagtggtggccacctgtaatcccagctactcgggaagctgaggcaggagaatcgcttgaacctgggagatggaggttgcagtgagccgagatcacaccactgcactccagcccaggcaacagagtaagactctgtctcaaaaaaaaaaaaaaaaaaaaaagaatgcacccatgcagtgcctcctgtcaccctctgcccagaaagggcacaggggccagggtgaaagagttacaggaagacagagggaaggaaaccatgcagacataaccacatgggggcaggccctaagctgctgggacctccacagtgtatccctttcctccaactgggagacggaagcaccgatggtctttctctacagtgccaggagccaccctgcccccagagatgccctacaatcaatgactaccatctaaatgcttctggatagtttcattccttgtagatgatattccaaatattataatttgtacttctccacaattacaattccagttttggggtttctttttactcattaaatttgaaaagccaattccagttttaaagcttgacccttttcttaaaagtttaacttctctttttattcaggcttcccactaaaccctcaaactgactctgagggtggcctgactaatttacaaaaccggccaggctgcctaacccctagattccagcccagagtgttgccataaattgctgtcaagacatgcctctatgtcccatgtttgccagtgagaaaagggttcatattctaagttcttcaagtctctctcactgcctcaatgtgaagtcaatggaaaacagtcaaatacaccaaaaattaacttcaaatggatatctgctatgaattccaacttggttggacacctctccaggccaactgttgtgaaaatgcattgttgttttaaaaaacactgtgagagatggctgggcgtggtggcttacttgaggtcaggagtttgagaacagcccggccaatatggtgagaccccagtctctatgaaaaatataaaaattgagccagatgtggtggcatgcacttgtagtccacgctacttgggaggctgaggtaggagtatcacttgaacctggaaggcggaggttgcagtgagccgagatcatgctactgcactccagcctgggtgacagagcaatactctgtctcaaaaaaaaaaaaaaaaaaaaaaaaaaaaaaaagagagagcgagagaaaacactgtgagaagaaagaagtcaatcaccccctctccaatgcccaacacagtaagcaagaagggcccaggaaaaaattaacagggaaaaacaatcttgcatttgcttagtggaatctggggtttgcacacattagtcagagctagacaaatcatactgaatacacttcttatagaaacattctagctcttatggcctttccttgctgtcccaacttttgaggtgcgaaaacacagcaacacagccaggaccggccaggtgatggcacggagcccgctcccacaggctgcgtgtgtgttctcactctcttgcaactggcctgagttaagccttctccccaagcacttgcagtttatcatcgccctatttactgtattttcatgttataaaagtgatatacacccaacgtagtaatttgatctatacaaaaaagagaagaaaaaaagctactcataatatcactgtctaatttaaggttttggtgtagtctttctagtctttttctatatggaatgtaatttacttctcaaaaatatcatttcatattctttgcttacatattagcatttttgtcatgaaatttatgccaactgattaaacagcccttgtaaattacagaaacttaaagacaatatcaaaacaatgtgaccacaagacaaagaccacctactactaaattatttttggcatgagattattttttgagaagttttataaactattaggtttattgaacactataaactgtaatccttgaaagaattttggaagcatacgataacagggtaatttgtagtagaatatagggttggaaaaccttaaaaaacacttgctcatttcttcctatatcaaagatttgtattagaaaatctatttcttacaaaaagatgtactaagtggtattatgtcagtcaagcatcttgtattattttctagctttcaataatatgtataatgtcataaaaaagagggaagaatacacaaaatacatatgaagcttactaggaatgaagaaagttattttaggaaggaaaaattggttaccatcaaggaatatggaaaacactagcaatgcatgtaagaatgacctcaaaggtcttagacgtccacgagctgggaatgcttgtgctgggtgcttcagttacaacagcatggggaagttaaatagactagtgaagctgttacatcagttaatagtatttattattatttgtggtcaccaatgccaattaaaacaataattaaatagaacatgatgaaataattcaatggtaggaaaaaaaaatctggcctacaagtgaacatggaaagtaaaagtaaatatttagaaagtgaaatcaggagtggaaaaaagctccagcatctcaccatggggtcttccaaagccagcagtactggagatgtttattgttcaaagatggacttgcttgggttgggattctccaactagagccagaggggagattctctgcttcccttgaggacacaaaaagagaggctttcttataaagcctgccacattctgtgcctgtattgttttatttactggagtctatcataaggcctgtgaggaaaggactgaatctctttctcatagccgttgggctgatggccctgcgtgctgtaggcatttaataattcactgagtaaatgaatgaaccctgcaggagattgggagcctttctgatcttgaggtctcagtttggactatctttctggaatggatagacgaatatgtttttcagcagcactctaataagcgcacattgggtgactaagcagaagagtgattcgttttgctagaattttccaacctgcaggagccagtccccctggtgtccccattccctgtcccctcagtcatctcagcaggaaattactatcctttctcccacatgggtgatgaatgttcaaggcatttcagcacactgtggtaaggcccagaatgggttcaagtaaaagtaaataccagtccttattaggagatcctggcccctctgctgcatgtgtcccagtacacatgcagcttcctgctctgtcatagaaagcagccctctagggccactgcctccagtgagagtttcctgacctccaggaacttctgtagtcaggcaccactcccttccctcacacccaacaccctgttgttccagattttatcactgtgcactgatgctcactgcgaccccacatgtggccacaggaggaactcggctgagggctgagaagaccagataatgacacagagggctcacttcaggaaacccagagagctgcagcggctcctccagggccattccacgcattcattttctaacaagtcataagtcaaagagtgacatcaggagcggacagcctggtgtccaggcatgagccatggcaacagattctgatttcccagaacggctttggtctttacctggtgttggatatggtagtgttagctggagtgggaggagattcacattgtatatttgtttagtgactccaaagattttaaattatattgtgttttttattattttattccatttttttagagacagaggtctcactctatctcccaggctggagtgcaatgatatgatcataggtcagtgtagcctcaaactcctgggctcaagtaatcctcccatttcagcctcctgagtagctgggactccaggtgtgtaccatgactcctggctaattttggtttaagtagagatacagtctggctatgttgcccaggctggtcttgaactcctggcctgaagcaatccttctaccttggcttccaaaagtgcttggattgtaagtgtgaaccactgtgtgggccctggtttttgtttaatggctattaaatgctcagaagtgaattaaggttgcagttaaatgcacaatttttatatcaaactattttctttgctaattcacttctatctgcgtctaccagctgtaaactacctgaagcagagaaagtttctttaggttggggcttcctgtagccccgagctgagtgtcttatgcagcattggccgagtgaatgaatttgttgggtgaactgctgcggggtttagagtccgcagagggtaggacaggacagatcgtgatagaggctaaccttctcatctactctaccatttcatgctctgtttgggcacctccatcacccctcacttcccctgatggtccagtctctctgggcctgcactgtccagccaccctcttatccctaagccaaggcctttgccaactaaagctcaggagtaaagtggccatcactgaggccattctatgtatgtatgtatgtatgtatttagagatggagtcttgctctgtcacccgggctgaagcacaatggtgcagtcttggcttactgcaacctctgcctcccaggttcaagcaattctcctgcctcagcctcccaagtagctgggattataggtgtccgccaccatgcccagcaaatttttgtatttttagtagagatggggtttcacccttttggccaggcaggtctcaaactcctgaccttgtgatccccccaccttggcctcccaaagtgctgggattacaggcatgagccactgcacccggctgactgaggccattctaaggaatatacagcaagctcttcagtacccatttttgttaactgaggtataactaaatgatacacaggcccagcacagtggcacaaacctatagtcacagcaacttgggaagctgaggtgggaggattgcttgagatcaggagtttgagtccagcctgggcaacacacgtgtataggtctatgagtctggaagaatgtatatagccatggaatcactaccatgtcaaaacataggatatttccattatcccaaaaagttccctcctgcccctctgcagtcaaacacttccctcccccaactcctggcaactgctgatctgaactgtagacctgaaaatgtcattcagaacccatttcatctggacccttctctctgtgtcaacattgctgtgagcggtgtctgtgggatttttctggacgttctctgccatgcccctgctccttccttcctgccttctggaaggcacccctgccaggagtcggctgcattaaagtgggtgtttcaggggtgtcttcctttactctcttctcactgatttccagctatccctgtgtctcttgtttaatgagtgccttcacccatatccttaaacccaccagggcgaccttcctgcccctttctttggagagctgtatctgtatttccagtggagacacagactgttccttagatcctattaaccctctgagctctctctcttcaagccaggctcatttctggcttggccaatctgcctcctcccgtgtcctttccatgacacggtgatggcatcaccagccagtcaccaagctagaacagtcccttcacccggcccctactgtaggaggatacttttagagtatgtctgcaattcacccccactctctgtatctacttctgtggccaaagtgcggaccttgatttcctctggccccagctgaattaacccacctctctgggcctggttctcttttcactaaacattctccacattgctgccagagctatttttctaaaatacacatcagaccacattcttctcctccttctttaaaaacaaaaaatcaaaaaaataaaaaaccaagaaacaaacaaaaaacccaccctaccgtggctcctcagtgtgtagagatcagattcaagttccgtgagatggtcttcaagatccttggccatgtgaccccgtcctgctatcccaatcccattcccattcccatccccagcctccccacctcatccaactccagccacattggatcaccccaggagaggatgtcatgtattagtactctggtgcctttgagtcaaaactcactgttttgccagttcagaggttgagccctttttgaagaatcccctcttcttccacagcccaggtaagttctaccccaggcataatgagctgttatccccctgggatctgagggcattcagaataccaacacaatgctctccagatacctctatgctattcaaatccatgcatctcacacctgctcatcttaaaatctctgtgcctcacatgcaggaagaattcaaatgatgctgattgaaaaaacattgtgtccaatattagatgaagcatgtaaatatcaaggcaagaatctgcactttttgtctgtctattgcttgtttgcacaatagagccacatggtttattataaaaaattattataatgtatgctgtttaagctcagatcactttgcactaatgatgatgataatgatgggttagaattttttttcttttcttgccatgggatctgccaggttttaagaattcttttttattctaaaccaaattcaggagcactcccaaagacaagaaatcaaatttaggccactgatggtaccaacggaaggctatcactgtgtagctataccaaatgaagccaatcttcatggattttaagcactttgataagcttttatatctctgctcatctcgtttacctccatagataacacaaaataacagaataatcaaccaatagcaacgtaatcccatcacaacaacatcaaaaatgagaattcatatgattcagtaatttcctaagccagaacttcccacctgatgtgctggggaagtgagagggtgaggactgctttccccagcccttagggtgactgggcagatcctgtctggtgtgagcattcaaccctactgattacatcattttgggtgctatgtgtgataaaggttgacaaccactgtcctaagccattctaccatttaaatagactgaattctcccaagttatgttcttacttgccttaggaaggaaattagtattatgactctaaggatcctgaacacatgatctaaaaaaagaaaaacccaaagcacaatggcaaaggtaggtgagacagagtgtttagaaaaatagcgaatactgtactattaattactcccaattctccctaatccatgatttttaaagagcgggtggagcataacgatttgaggcactgcgacaatgcagaatggggagggattttggaaaatgtgactcactcaccgttccgaccaaagggtaaatgaacccagcacctatgctggcccggacatcactgataggtaagatgaagtcccttggcacaccttttttgtcaggttggtgagacagagaaagatcggtctttgccatgcagatgggcaaatttccaaaaccctgtaagaaaggaaagaaaatgtgttcactgatatagacgtgagtctcctgtgtttttcaatttgcactttatacagtctcggcagcaatggtatgccagctcagatcgaggcacacgcaggagctgcttgttactacttgttcactgaagaagcaagaaggtgaggataaaaactcatctccatgtgatgactgtttagtaggtcaggggtgactattgtttattttggaggttctcgttaagagaaggcagtgttatgtgcatgtttgggaaaagcattgctatttgcaggcaaagcagcagctgtagaaaccgctttccaagactattaatatccgggacccagcaaggtagtctggagaaaggctctgcgactaggctcttagtcatgttgttcactcattctggagtcagtcaagaagcaaagggttcctttgtgttggtttatgaatcatggttatttgatctgcaactacattacaagagctaagatgaggtcactatttaagcttcttgtttttaaggacaaaagtctatgtctgacccagagttccaaaggtgaaagagcaggaagtcacatgtggtgtctcacaaaaagcacagtgtcctataagcctgtttctgattaaatggcacacagtgttccttcagaggctttgctaattcattgcaaccacatacttggcactaactttaaaaaaaataaaaatagagatggaggttttgctatgttgctcagagtggtctcaactcctggcttcaactgatcctctgccttgcccccacaaagtgctgggattacaggtgtgagcaccgtgcctggttgacacgacttttaaggagtatttccttgatagagataaagggaatgaaatctttagtcaaattttcataagacttagcctaaaactatttggaagatcttagagtcttatcaacttagggaggacttgggcttggggccattttctttttgaaatctccactcttctatactgataagaattttgctgagtgagaatcacaactgcctttcagaatggtgccagaattttgaatttcagacatggttaaatattaaagtaatttctataggtttgctaatgtaaaaattttgttagtaggcatattaaaaagaaacagaaaccaaccagtatgctatatactgtcaccagattacttcataaaagaaataacattttaacactgaaaggagaaaagacttaatattacaataaatgatagtcttaaatatcattattaaaaactcggggaataaaaaacaaagcaacctcatgagaatgaccttattttacttggttcattgcacatgaatgaaaacttcaccacaatgcctaggcacagagcagtgcttgggaatcctttttgtaaagggtaagccaagaacatcagggaaaattctaagaatttagaactttctgagttcctattttaccaaacctaggagaacaaataccctggctggcaatggtagcatttaacaaaatttcaaatgggtttacaaaaaagaataaggagttggagattgtttttaaagataaggtcaacactaccaatcatgaagctctttagccaacaggctcttaaaatgttctgacttctatctatctgattacaccaaagtaggagggacactggaggcacatgatccttttggtaaaaggtggctgagcctcctataatggagttgattcatcatgactgtcactggactaggtgatgacacatgctgtcagatcgtagccactttcccagctgtttgcctacttgcctttctcagtggctagaggtagaagatgatggagccttcaacctcagtggaccagctcagtaaaaagccaatgaaccgcttgcataagaacagcaaacattcccatctttataggctgcactcctatctgcctaccctggcaccttgctagcatttttaaggtagtaagaggcctgtaaggaagaggaagcattgcaattcatgcaaatctgactccgcagctctactccaaaggatagtttcaacgttctgggctgagtgggagggatgaaagatcacacatcacctacaaacagggataccacccatatcagacacatttatagtcacagaagtaaatgatgcatggatcagaggatacatgcctcaccataaagttctaaatatagtttacactctacccgaggatattgctttcatctttgttaaccagaaaatagattaagcaaaggttagctggtgagacatgtacaaatcctcaagtcaagctgagtattctgagagcctaaggtgaattttttcttttcccctaaaagtacaacttttacctgctgagtgtaacgatctattttgacttgtgcctcaggacagagttcgatatctttggctccatagacagcctgggcaatggtccttatcttgtccacaattggaagctgcagaaacacaaattataaaaaaattgtgtaagtttaatctggttaaagatttttttaaaagtttagtgacacttactgtaattgcttaaaattcccttatcagggtaccccctcagcaactgcaggattccttgcaaaccctcttttttccttttagcaccctaaagcactgaaattttcagtgtcagaatagatcggatgtcaactagcaaataagccttaggtgttcaggcaatttagaggctgcctagagcccatgtagaatctgcagagggaggccgggcacagtggctcacacctataatcccagtactttgggaggccgaggcgggtggattacctgaggtcaggagttcgaaaccagcctgatcaatatggtgacaccccgtctttactaaaaatccaaaaaaactagctgggcttggtggtgcatgcctgtaatccgagctacttgggaggctgaggcaggagaatcacttgaactgggaggcagagactgtggtgagacaagattgtgccactgcactccagcctgggtggagtaggactccgtctcaaaaaaaaaaaaaaaaaaaatctgcagagggaagagggaagttagtgccttacagagggcttctgactaggaagccccagaactgcggccgaccccttcctctccctgcctcacccctgcagaaagatctgcagaaaaagctggaaggggtgggatggtgtgtgtgggggtggggactggggctatgcagtttccagacctggtctttggcaccctctacaggacagttccattcccacacctgagctttggacaactgaatcctatgccccttcccacccagggaacctggtgccagaaattcccaggacttacccaccatccaccacgccacatagcaagtgtcctcagtgtctgcagaccagaaacaactcccttgtgtctcagcactgggccacctgctgaaaccccaaactgcctgccccattgtttgagacccagtcaggccttggctccaaaagtcctcttggactgccactggcccccagggtctctcctgactgcacctcggtcccggagctcccacaccgctgggccccgagccccatgccccgatccagctgtggctcctttacgggggccttgctggcctttcctaagggaggtgttttcccgagggcaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctctcccccttcagaatgggggttccctgaggactgacccagggcctccccccgtcccctccatctggctgttaatctccaacacttccacctccagtcctattctgcacagcgctccccagcgctgggagctcagaggcctcttcagccttccccagggctggggctcagggagggcttcctcaggcgctggccccagagtcaggctgcacattggcttggaggacaggcctttcctctgggactgtgaggcccagagtgcccacccagaactccacctctgacctcacaaaggcctgcttcagaactcagtctccactgcactgctggccagacgagggaagttattttgggcagtgcatctggacttggttcaagtggcaccagccaaatccctgccttactgacctctcccctggaggagcaggagcagcgctcaaggccgccttgggagggctgagaggcaggctctggactggggacacagggatagctgagccccagctgggggtggaagctgagccagagacagtcacagaggaacaagatcaagatgcgctttaactgagaagcccccaaggcagaggctgagaatcagaagacatttcagcagagtgagtggggctccaggcagggtggggatggggcagcctcctcagtgcccagatctggaagggtcattccctgggtaccatacagcgaggaggtgactgagggattgtttggggaaggagccccggctgggagtggaagtcccggctttcttgttatggtgcagtcctgtgttgctgtgtgacacaggcacatacaccttctctctgggcctcagtttccttacctgtaagttggttgttgggaggaccagcggtagagcagagatggcagggatgcactgggctgggctgtcagcagaccatgggggtgggacgaggagagagctgaagaccaccggcagtggaccacagggggaggcatgcaggccagagacgggtcagctgccggcttgctggagtcattcctcccacgcagtcccctcctgaggggctggagctggggctggagggtttcagcagtcagggctggagataagagtctgtgctggagctagagggaactgggctagagaatcaggaggacagacagggtgaggggacttcgggctaccttcatgctgtctgttagagataaagataggagtacaaaggggaatttttgggtgaggtacacgggtgaaatgagttttcagggcctcatcctgtgtgttcaccttctgtgtgtgtgtgtgtgtgtgtgtgtgtgtgcatgcgtgcatgtatgtgtgtgtgccggtcctggacagtcacagcttaagttagcagcaagagaacttgaggttaaaggtatagcacgcaaatatgaggctggagccactgagtagaggctgagggcatctccacagtccaaagctgggctgcagacagggaaggtcagcaggagcactggagggtctggcctggggttggggtcctggggccagcatgggtggggtggggctccagggcgtcgcctcattggctgagcaccgctcctccctccctgttccttggctgggttaagggagtggcactagcaggagctgccccagggcttctcccctggggacaaagatctgatggaagtgtggggccaagttctgtgtcctccagccctagtgacctctctttggctcctcagcatctacaaatctgaaggacaaaacatggttcaagcatctgggcacaggcggtaagtaccccaccctcttctcaccctccagccccctgtcctccacccagcccacttcagtgccctccctgctccatcctcagcctctcccttggggcagctgtcccccctcgacctcctcctccccacccacccactcgcctctgaggtcccagaagaaaagcatcttccacctgttgcctgggctgggtcctggggtgaggggaggctcagaaatacttggatgagggtcaaggcatgcaggtggccttcaactcaactgcactcagcacctctcaccctctcaggctcagctgtctttggggtgaaaaagagccagtccttgcaatggccaaggccctgcctatgtagtccttgttagctttctggcctccccactccagccccctgctctccctcctccagccacactgagtttcttttctggtttttttttttcttttctttttttttttttttgagatggaatccagttctgttgcccaggctggagtgcaatggcaagatcttggttcactgcaacctccttctcccgggttcaagcgattctcttgcctcagcctcctgagtagctgggattacaggattacaggcacacactaccatgcccagctaattagttgtttgttttttttttttttttttttgtatttttagtagaaatggggtttcgccatgttcgccaggctgttcttgaactcctgacctcaggtgatccacccacctcggcctcccaaaagattgggattacaggtgtgagccactgcacctggcctcacactgactttctttgctttcttcaaacatgctgagagtcctctggtgactattccctccatctgagaggctttctgcagttaacatacagcccactctcatctccttcatggctttgctccaaggccaccttctcaacaaggattactctgactgccctatttgaaatcacaccccatctccagcccctgcactcccaattcccctctccttgctctgttttttcccataggagctggtaccttcgcttatacaaatgtacttacttattacatttcattgctgtcagctccacgcaagcagggatatttgcctgttgtacacttggacggagagaatgaatagtgcccctctgttgacatcattgcctctagcctacgtctctttccagggctttagatcctgtttctagagacccactggtgtctcacaggcaactcagctcctagatggaaacagcctcctccgccccccacaagtccactcctcctgtgctcttggctcagtcaggggtccccttctcttcagttgctcaagccagaagtcaaggtcatgtccttgatacttccctcttccccatgcctcacatccagtcaccaatctcctaaaatatctagaatgtgcacagcttccaccattctttctaccaccaccctactcccccatggccatgtcaggccaccacccgcccattcttcaaaactcccttcaggcctcacctcccatgcctcccctgagttcccccagtcccaggctgcttctctctggtggtgttgccattacccatctcttctattaaacagagtgacccaagagtggagagtgggttttgactttgtatccctggtgcttgactcataagtaggtgctcaacaaaaattttttctttttttgagatggagtcttgttctgttgcccatgctggagtgcagtggcatgatctcagctcactgcaacttctgcttcttgggctcaagcgattctcacatctcagcccccaccccagctgggattacaggtgcctgccaccacgcccagctaattttttttttatttttagtggaaatggggttctgccatgttgtccaggctggtcttgaacttctgacctcaagtgatccacctgcctcggcctcctgaagtgttgggattacaggcatgagtcaccatgcctggccaacaaatgtttgttgaatgaagaaatgttggttagcaggttgaattgttggctcgtggttagttggatagtttatggttgactggttgattagataattcaatgagttaatagctggttaacaggagaatcagttagttggtttttgataggttagtcaaagggttaataagccaccgggcatgttggctcatgcctgaaatccctgcaccttgggaggctgaggctggaggattgcttgagtccaggagtttgggaccagcttgggtaacatggcaaaaccccatctctacaaaaaataggaaaaaatagccggtcatggtggcatgctcctgtagtcccaactacttgggaggctgaggtgggaggatcacttgaaccctgggaagtctaggcttcagtgagctgtgactgtgccactgcacttcagcctgggcgacagagtgagaccctgtctcaaaaaaaaaaagaaaaagaaaaagaaaagaaacaggcgttagtgagttgttagctatttagttccttggttaacagattacttaggggatctggttggctgtcagtttcttgctttgtaggctggctttcttgggcccctcttcttagtctgtaccctctccttgagctctctcatctatgcccatggctcagatgaccatctgtgatttgctgtcctccaaatgtgtctgtaagtgagaccacatgaccagctgcctcctcactggccatcccacccaagtgtctagcaggctcctcacactcaacatgtccagaaagggcctccttgtccattcttccacagcttctctgctgtgccccacgctagtcattccgctgccctagccaggacctgagggcatcgctgagctgccccgctcccttccctctctaaccgaacaccaagcctgtcagcttgactgtgttcttgtggccattggcactgccatccttgtggctcagactgccaccacttctccacccatctgtggagaagctgatgctcaccctgcctccactccacttcctccatcctggcctccacaggggaggcagctctcctgctgaaaccctccacttggcccatggccctctggtagagttcagactccctaatgtgggccatgaggccttctgccacctggccctggcccctctctgcccatctcatgccacctccactcctccgtggccagcccattcctgcacattggatactgccttagctgcaggcctttgcacatgccagtcctacgcccagagtgatccctgcctccctggaggctcctttaccctccagccttcttttcttgacctgaatttccctttctctgggagcctcctaccccctcctctaggccattcacttcctccacatgccccacagtgcccactctttcagctggggcaatgctcatcacactgcatagtaattgctcaattgattgcttttcttcccacaggctggattgtaccagtgtcttttactgcagtgactgaacattctaggcacagtagattcaagaaatcttgagttcattggctggttggtggttatctgttgcttactgtgtcttgcctgctgtgtggtgatgaggaaggagccaggcttccaggattctcttggtgttcttgtctttccgctctgtccacttctctctcctcttctgtggttacctccagcatgggaggtggggttggatgggagccagtggagggtcacctcgccctgctagggagagcagcagcattcctcagggctcctaaattcccctgacctcacagcagcaaaaagtaagcagagggaatgagagacgtccaggcatggaataaaacatcttccacttttcagctgagaccctctgttcatggctcacccatcccagtccttgctctattccttactccagagaaacaaaaccagggatgagtagatggagggggatgcagagttgcgcggatattccactggcccccatccaactccagctcccatgcagcatcgtataggggtctcattatcccatgaccagcctcctcagccctgaagaagagaccctatcaatgcaagcagcagcccaaagacagtcctgggaaggtaccatagaggcaggggagaggtagacagagcagggagccaagaacaccaagggaatcctggaagcctggctcctttctcatcagcacagagcaggcaacaaccagccaaggaaccaaagatttattgaatctactatgcctactatgttcaggcactgcagtgaagcaaactggtatgatcccagcccttaggaagaaaaaccgttaattaattaagctttttttttttttcttttttgagacagggtgtcgctctgtcacccacgctggagtgcagtggtgtgatctcagctcactgcaacctctgccttctgggctcaggcaatcctctcacatcagcctccccattagctgggaccacaggcgtacaccacaacacctgactaatttttgtattttttttttttttgtagagatgaggttttgtcatactgcccaggctggtcttgaactcctgggctcaagcgatcagctcgcctcagcaagtgctgggattacaggcgtgagacactgtgcctggcctaactgagcaattactatgcagtgtgatgagcattgccccagctgaaagagtgggcaccgtggggcatgtggaagaagtgaatggcctagaggagagggtaggaggctctcccagagaaagggaaatttaggtcaagaaaagaaggctggcgggtaaaggagcctctggggaggcagggaaccattctcggtgtaggactggcatgtgcaaaggcctgcagctaaggcagtacgtgatatgcaaggatgggctggccagaggagttgaggggctggtgtcagcttccgggcatgcagacagtgagatagcagagtgactaaggccacacttagaggtatctgtatccctcttcttcctctttttttttttttttttttttgagatggagtctcgcacttgttgcccaggctggagtgcagtggcaagatctcggctcaccacaacctccatctcccatgttcaagtgattctcctgcctcagcctccgaagtagctgggattacaggcatgcgccaccatgcctggctaattttgtattttttagtagagatagggtttctctatgttggtcaggctggtctcgaactcctgacctcaggtgatctgcccactttggcctcccaaagtgctgggattataggcgtgagctaccgggcccagcccctcttcttcctctttatcctccagtcccaccccgccaccttccccaaactccagtcctatacctctccctatacgcagatttggaacctgttactcacctgtttcatctacctttccatctaaccgtgcacttaactaaatataaatcaagtgccaggccctttggcaagctctgaggatctagttgggagtaagacagattccccagttttcacccattcaacaaatacttattgcacatctactatgtgcctggcatggtgctgggcactaaagatacaccaggaagtagatccagtccttccttttctccctcccgctctcttggtcattcattcattcattcactcactctctcacaaacctctgtttgcactgacctggttgcacagcctggtgcattttgctgaccccttcatttttgacagaacctggcgcatgtttcagtgctcagtgctgtttacagagctcggcagcagactttgtcacacttcatgctgtttgtagagtgcctcactgttgccaggccctggcctgtgaccccaaagttctggctctagcagataggcagacagacagatggacagacatagactactgagctctactttccagcctgctctctcccaccctactttttcccagaggcttgttggcaccgtggattgcactttcagctccccacctgtccgtctgcaaagtggcctcattggtgtgccatttttactggtccagtcccaactacaaggggcatggcttggccatctaccccagttcctctccatgtccccatggctctcaagtgtctccaattccagctgtcccagctgccccgggcaagaggaggtgtgtgtggcaagtctgctgggttacctattaactcagctgtgagttgaagagccgatgggcagcaggcagacttgagtctcctttctgtccatgagctcgggccactgtatcaggtccacccgtggctccaaaatggtctcctggtccgtgatagcaaagatccaggaaatatgatgcgaggaagatgagaggaagatggcgcgagagttcctggccgagttcatgagcacatatgtcatgatggtgagtgggcgggcagcacgaagtgggtgggctctgccagggccttccatgaccccctccccattctgaccccatgggtcacattgtccattccttgcctctgagctgggagcctggggaagcagcgaggaaagtaaggggggggggggctttctcatcaagtctttttggacagaaagggctcataatatgtgggggtcaaatgaaaccatgcactggggtatccggggcaaggctggaaatggggagaagggaaacccagagtaaagagattgaagaggcccaggtgcagtggctcatgcctgtaattccagcactttgggaggcttaggcaagtggatcacctgaggtcaggagttcgaaaccagcctggccaacatggtgaaaccccgtctctactaaaaacacaaaaattagctgggcatggtggcggacacctgtaacctcagttattcaggaggctgaggcaggagaatcgcttgagcccaggaggtggaggttgcagtgagctgagatcacaccattgcactccagcctgggtgacaggagcaaaactctgtctcaaaaaaaaaaaaaaagaaaagaaaaaagagagagagattgaagagaaacttgatgatcaggctctgataatgaatccagagggcaatgggcgatgttgaaggctggcaagcaggggagtgacatgatcagatttggattttaaaggtaattttgggtgcagtgtggagcataagcaggacaggcaaggctggcaagaaggaaccagttaagaggctgtttttgatctgggacagagagagggtgatgactgatctggggttggagaagaaagcacatgtttgagagggctgtggaagatggaatcggggagactctgccagcagaacatgtgggcaaagcgccgatgagctgttctggagcacggggcccagcacagggtgagaggcaagatgcctgtagggaaatccaggagatagttaaacacaggcaagggtctggagctcaggagaggcttggtctggaaggaaaaagttgaagttcatcacaacacaggtggtggttgtcaacactgtctagaaggagtgtacagaaagagaaaaggatggtttgaggacagagccctgaggaatgaagaggggcacgcaaaggagcctgagaaggaatggtcagagaggtgggaggagaaccagagccgactgcatgacagaggggggcagtggttccaccaggaagaagccatcagcggcatgggcagcggcagatgggccacgcaaggtgagcactggcaaggggccttagggtttgccaatgtggaggttgctggtaaccttgacaagggctcttctttagtgtgtgattgggacagaatccagactgcaggtgggatgtgaggttgctccctctccacctgcttcagccctgccacttaccccagtgagcctctgcccttaacatgactgtagccatgtttattgcatcttatgcagggtccagggtctagagaaagaaggggcagcctctgggaagggaggcaaaggcagccaggtgcatgctagaggaaggtggggtgagagaggctgttcgtgtgtgtggtggggcccatggagctcaagggagagaggaaattggaacaccaggtttcttagcctgaccctgccactgagtgaccagttgccttgggcaggtctctccctggcttaaagcctgacttctcacttatatcgtgtagaattaggccttcgtgggctttggagctgtgtttgaatcctagctctgttatcttctagctgtgcgactatccacaagtatcttaactgttcacaaatttagctttcttgtttttgagacagggtctcactctgtctcctaggatggagtgcagtggtacgatctcagctcactgcagcccccacctcccatactcaagtgactctcttgcctcagcctcttgagtagctgggactacaggcatgtgccactgtgctcagctaatttttctatttttagtagagatggggtttcaccatgttggccagactggtctcgaactcccgaattcaggtgaccttcctgcctcggcctcccaaagtgctgggattgctggcgtgagtcacctctcccagcccacaactttagcttccttattggttaacaggaggacttgtgtgaagaaggccaagtctcagcacccagtgtggtacccatgtattggtcccttgttattaggacgggtgctctagctgctgtctcctctctgtctctggccctcccctactcctctcttacctccccacctgctttggctcctgagctgtgaggacagcagttggatcctgtccctccttaatccagggcaaagtaattcacttaccacaagacattccagccccatgagggctgttaacccttggagcctcggaggcaggagggtgcatcctctgagagctgttagggaaataggcaccgcccacatgcttgatacctgcccacatctgtgttcctcttccttttgttgagattttcattgagcacctaatgcatcccgggctctgtgatgctaagccccttacgtgcagcatcttcccaaatcctcgcaatagccctgtgaagtaggtactattattatcccagtttcacagatgggaaaactgaggctccttgagactaagccttttgcccaaggtcacactttaagtcaagattaaatccagtgcagtctaatatcacagtcttttttgtttttgtttttgtttttttgagatacagtcttgctttgtcacagtggtgcaatctcggctcactgcaacctctacctcctgggttcaagcgattcttgcatctcagcctctggagtagctggaattacaggtgcatgccaccatgcccagccaatttttgtatttttaggaaagacaaggtttcaccatgttgtcaaggctggtcttgaactcctgacttcaagtgatcctcccacctcggcctcccaaagtgctgggattacaggcatgagtcaccgtgcccagcccaatatcacagtcttgacccttaacctctatgctctgtaccttagcttaaatattgccagcttttaaagactcgcttgttaatgctcccccagccagggtaaagtcctcactttcaggtagttcaagatgcctctctcggcctcagtttccccatttatagagtgggagaaaaattcttgctgtgcagatttgttgtgaggattgaagacagtagcacttgtaaaagaactttgtgaggcgtaagcctaaatcggatattgtggtgttgttatttttagttgccaggctgtgccaagaagtgagggcttttttttttttttgtaaatatatatataggaatctcagtgagtcaccagggtgaagttttgccaaaaaagctagtgtgaccttggccccatttattgcagccaggacaagggaagtggactgatccgtgttgcagcttccaggtgtgttgcccttggagctggcctcctggctgtgggggagagttggatgggctgggccacattcactgatcagggagaggaggggctggagccatccgggccctggaaaaccagccatacacatgagacacggggcaagggttgtagatcacatgctacgggggccaagagagcggcaactcagggcggtggggactttggctggctgcagagtgccaatctgtgcaaggctgtagagctgctgccactccagctgactgttgccatggagggtggaatgcaggccagtgttgcttgagctgctcatttttcaagagagacggaaacttctgttcttcaaaaccaagttatctaaacaaaatctgtgcgctggatgaattaggtgcatgagttgccagttggcaaccctgacacaaggaatcatgtggggttcattcattcacccagtattttattttatttattttatttttttgagacagagtctcaccctgttgcccaggctggagtgcagtggtgtgatctcagctcactgctctgcctcccgggttcaagtgattctcctgcctcagcctgccgagtagctgggattacaggcatgtgccaccacacctggctaattttttgtatctttagtagagacggggtttcaccatgttggctaagcaggtctcaaactcctgacctcatgatcggcctgcctcggtctcccaaagtgctgggattacaggcgtgagccaccacacctggcctatgctcatccagtatttttagcacatggtattggaatgcgggaaaggccatgggggcccctctgttttcagaccctccatgcctcctccagtccctctacctcttgaccctgccagcctgtcaacctgtcctgacctcactcccccctgcacccccatctgttcctgtcctctcctgctgtatcttatcctggatctgaagccagcctagctctgggctcccctgctcctgtcctggggcttctgagggacccagtgggccctgctcagctgcctctcccccaccatatctgggctatttcacattttctcagacttccccaaagctgctctgtactctttttttttttaaatcagcaaatggcttgatctgctgcttgataggtaaaataatcaacacttcctatgttcagctcaccctcttgtccctcttaccaccagacccattaaccacccgtgtatccacatatcaccccttggctggggtggggtcctctccttcctggaggacacctccacttctgcaccaatccagctgtccagcctattcaggtactttactctgtcctttttctctgtcctttatcttcagcccatccctctctcagcctataaacatactgaagtttctccactgaaaacaacacaaaatgaaacatccctcccttcaccctgtcagccccttcacgggatcatgttctctcttccccgctcctcaggcgaattctcgaagaggagtctacactggtgcctttcaactcttttttttttctttttttgagatggagtcttgctctgtcgcccaggctggagtgcagtggtgtgatctcagatcactgcaagctccacctcctgggttcaagcaattctcctgtctcagcctcctgagtagccgggattacaggcaagcaccaccacgcctggctaatttttgtattattagtagagacggggttttgtcatgctggtcttgaactcctgacctaaagtgatccatccacctcggccttccaaagtgctgggattacaggcatgagccaccgcacccggcctggtctgccttcttaccttgtaccctctcctggggccttctcctctgtcggctttgactttggcccttatgtctacaattcttcaggttttctcctttatcaactctagaacagagttctccaggggaaatacaatacaagccatctgtataatttaattttttctagtatccacattaaaaaggtaaaaagcaacaggtgaaattaattttaataattaacccatatagccaaaatcctatttcaagatgcaatcaatgtaaaattattaggatattctggccaggcatggtggctcacacctgtaatcccagcactctgggaggctgaggtgagaggattgcttaaggccaggagctcgagaccagcccgggcaacatagtgaaacctcatctctacacaaaataaattgaaaaacttagctgggatagggctcaatggctcatgcctgtaatcccagcactttgggaggccaaggcaggctgatcatctgaggtcaggtgtttgagaccagtctggccaacatcgtgaaaccctgtctctactaaaaatacaaaaaaatagttgggcatggtggcatgcacctataatctcaactactcgggaggctaaggcaggagaatcacttgaacccgggagttggaggttgcagtgagccgagattgcgccattgcactccggcttgggcgacagagcaagactgtctcaaaaaaaaaaaaaaaaaattggctgcgtgccgaggcacatgcccatagtcccaactacttgagaggctgaggtgggagtatcacttgagcccaggagatggaggctgcaatgagccctgatcatggcactgcactccagcctgggtgatagagcaaaaccctatctcaagcatcaaacaaacaaacaaataaaacagaggcacaagaaagcaaggcatgcatggagcagcgcagttgtttggtttgaggccatctggcacaggtaactgcctggatttaatcctggctcaccatgtacaggctgtgtgaccttggacaagccattcaagttctctaagcttcagattacccatctgtcaagtgggggagaataatagtgcttaactatcatttgcaacatctgagtttctggctcggccaacggggatggggaacatagagtgaggagcaggtgtgctgtgagatggcgaaccttcaacagagcctgagacgtccgcggaacaccaggagagttgcagtggggatttgcaaataggcatctggctcccccacggagatgacgggaatttcagcgcatcaggcatagctgagactgtctacgtggtaaaaccatgcctgaaaagacctttggaaaatcaggaggttgctggagcccttggagagagctttggtgtctgtgacatgtggaaatggaagccagattgaggagggggtgcgagggaaggggtgaagcagctggccagtgtgttctctcctgcagcctgactgaaacagggagggggcaaccaggaacccacagctggagaaggacactgggcaggggtgggacagtttgctgggaaggatgagactccagtgtgtgggaaccgatcaatgggaggatggaaggtatgggggagacggaggcctctgcagagggagaggatagcacaggagccagggctgaagggaacagtggctctagactgagggtaatgggcctgaaggtaggccccttcccctgtgaaggcagcattatctgaggagccgtgagggatgggcaagaagcagcagcttgggaatgccgcctgaggtcagtggaaatgaagctgagggcaagacagttaggggcccactgttccagcattgtgggaattgcggtggagtgtgtgtgtgtagggaggggttcctggcagagtcaggcatggatggatttggaggtcccttgaagaaacttccttcaggtcagcctgaagtgtgagggactctgagggggtgcaatgcatgccagccatcccctcctcgcagccctgcctcaccccaaaacttcaggtgggcctggggctgaggtgcttggatgtttgtagtaagagcttctaactctgccgctccacccggctctcagtggctcaggtctgagaggcctcagcaggggcaaggagaggaggcagtgaggagggaaggctctggaggaagagggcatggcagagggtcttcgaggcaacgccagggaggcccagggcatgagggtgaggagctagaactgagctctgagccctcctctgaggttggggcttctgggcaggcagcccccttagaggccctcccttgtaggtattcggccttggttccgtggcccatatgcttctaaataaaacatttgggagctaccttggtgtcaacttgggttttggcttcggagtcaccatgggagtgcacatggcaggccgcacctctggtgagtgagcccaggccctgccggaccgggcaagaccaggtgtccccaacaggctctttcctgcccgcctcagccagctcctttgccagcacagccagtgcctcagcctggccaccgggcgggaggaagtctcctctgaaccccgtgcctatgacgtgtctgccccagattcttcctggcccccccgacctaccattttcactggctgggtcatcttaggcaagccatcgcctctgtgttcctcagtttccttaagagtgaaaggaagacggtggcccctgcctcacggggtggttgtgagggctcaaggagagaactctgtcacggagcatgctgtcatacacactagccatcgttgttctcatactgtttgtcactgttgtttgttctgctctcactccctgacacacttgcctgctgcccgcaggagcccacatgaacgcagctgtgagcctcactaactgtgcactgggccgtgtgccctggaggaagtttccagtctatgtgctggggcagttcctgggctccttcctggcagctgccaccatctacagtctcttctacagtgagcgtcctgcccgggtgtccgcctctggcctcagctgcctcctatgaaatatgggcagattggacctcagtgtcctgatttgtaaaaaatagctgggagaaaaaagccttggaggtctcccaccctctaacctataacctaatttccgggaccctggtggggcttagctggggacaggttcgcatgatagtctgtgtctccacagcggccattctccacttttcgggtggagagctgatggtgaccggtcccgttgctacagttggcatttttgccacctaccttcctgatcacatgacattgtggcggggcttcctgaatgaggtcagtggtccaggatgagtacccctccccctgccctccacccctcaggacggagccagcagggagtccctccggatagacaggacaagaactctggatggagactgtaccaagatgtgtctctgctggtgggcttgggtctggggcactgccgaggtcctgtggcttggggaggggcccaggtgagcttccacagcatctgctcctcaggagtggctgaccgggatgctccagctgtgtctcttcgccatcgtggaccaggagaacaacccagcactgccaggaacacacgcactggtgataggcatcctcgtggtcatcatcagggtgtaccatggcatgaacacaggatatgccatcaatccgtcccgggacctgcccccccgcatcttcaccttcattgctggttggggcaaactggtcttcaggtactgcccctgcccaggcccattcctttgagattttctgtggggcccctgtgtgttgaggtgtggggggtgatgtgaggggcagcacaggagggtcctgcagagcccccaggtggcctggggagcaggagtgagtcccaacatttccccaggccagtacagatacagatcctgcacctgcactgagtgtcaaccctgtccctgaatcgggctgaggctgaccagggccccgggttgggggtgtttcctgggttagcctgaggatgactcctctgctcaaccagtcttggcccgaggtggatgagggtgctgtcctgggcatcagccccctcagccggcctctgcctcttgcctgcagcgatggggagaacttgtggtgggtgccagtggtggcaccacttctgggtgcctctctaggtggcatcatctacctggtcttcattggctccaccatcccacgggagcccctgaaattggaggactctgtggcatatgaagaccacgggataaccgtattgcccaagatgggatctcatgaacccatgatctctccccttaccctcatctccgtgagccctgccaacagatcttcagtccaccctgccccacccttacatgaatccatggccctagagcacttctaagcagagattatttgtgatcccatcccttccccaataaagagaagcttgtcccacagcagtacccccacttcctgggggcctcctgtggctgggcttccctcctgggttcttccaggagctctagggctatgtcttagcccaaggtgtagaggtgaggcacctcaagtctttcatgccctgggaactggggtgccccagggggagaatggggaagagctgacctgcgccctcagtaggaacaaggtaagatgaaagaatgacagaaacagaatgagggattttcaggcaagggggaaggaagggcagttttggtgaaaggactgtagctgactggtggggggctggctttggaaatactttgaggggatcctgagactggactctagactctcccctggttgttcccttccccgagttctggccggttcttggaccagacaaggcatggcccaagaaggtagatcagaattttttagcctttttttcattagtgccttccctagtattcttccagattttttttcttaatcacatgaaattttaataccacagatatactatacatctgtttatgttctgtatatgttctgtgctttatacgtaaaaaagagtaagattttttttcacctccccttttaagaatcagttttaattcccttgagaatgcttgttatagattgaaggctggtaaggggttgggctcctctttcttcttcctggtgccagagtgctcccacatgaaggaataggaaaggaagatgcaaagagggaaatccttcgaacacatgaagacacaggaagaggcctcttagggctccaagggctccagggaagcagctgcagaggttgggtggggtgaggggccaggatccactgaccctggggccaggcaggaatcactctgttgcctggggctcagaaggcagtatcacccatggttcctgtcattgctcatgtattttgcctttcaacaattattgtgcacctactgtgtgcaggccctgcctggacactggggatgcgcagtggatgcactgggctctgcctttgagggttgcagtttaatgggtgacaggtaattataaggaagaaggtgagtgcagagtgggaggcttggaggctgtggggcttggggtgggggagctcacatccagcctctgggccaaggccaggaggcttcccagaggaggagacagagcagggtattgtggtggggggtgtcctttttggggctgggattgcactttacagtttgaggggatgggcagaggaggctgggcttcattctggaggtggggacatggtgaggtgaggtttagaaagcacacctgagccgcagtgtgtaggatgctggaaatggtggagatgggcctgcgaagagagtgctgggaagtgatgacccaggagcagcagccgggcacctaacaatgggtcagcaccgtgggcgtggagacaagggccgggattgatcaatacccgagaagtacaatgtacaggacttgggctccatttggatggagtgggtgagggaggagtcagaaatggcttccggtttccagcttgggcctggggattggagatgtccccactgagagtagggcacaagtgaggaaattgtttggagaggaagatgataagttacatcatggatgtgctgagtctgagttgcctatgggacttggaatggggggtggcaaaaggtgtgtgatcttgagcaagatattcaactcttctgggccttggtcttctcatttgtaaaacggtgataagaatattacttcccatttgtgttgctgtgaatattaaatgcgctaccacatgtaaaatgttgagaatcgtttctagctcagagtaagtgctcaataaacaccattatgccttttatatggtctggagctcagaagtggaagacagggttttgtgaagtcatggctttgtggatgtagctagattgtggagtaatggcaggagggtcgggggcatggcacaaggtaggtggtcaagagacactggacacaacccaaatgtccatccacaggggaacagatacatacactgctgcgcaattgcacataatagaatcctctacaatagcaaaaattaaggcacaacagacacctgcaacaacacagaaaaattctggaggcataaaaagtaatacagtagctgggtgtggtggttcacacctgtaatcccagcactttgggaggccaaggtgggtggatcacgaggtcaagagatcaagaccatcctggccaacatggtgaaaccctgtctctactaaaaatacaaaaattagccgggtgttatggcacacacctgtagtcccagctactcgggaggttgaggtgcgagaactgcttaaacctgggaggcggaggttgcagtgagccaagatcacatcactgcattccagcctggcgacagagcgagactcggtctcaaaaaaaaaaaaaaaaaaaaagcctggtgtagttgggcacctgtaatcccagctgctcaaaaggctgaggcaggagagaatcccttgaacccgggaggcggaggttgcagtgaatggagattgtgccactgcactccagcctgggtgacagagtgagactgcgtctcaaaaaaaaaaaaaaaaagtaatacggtagactatatacagtgtgacacaaacttgtagctgaaaaataagcaaaaacacattctttgatatatatatatgtatgtaagaaaactactttagaaaaagaaataattcctacaggcagatggggaagaacacaggagtagtacaagctattaataattttctagttttggagttggacatttgtgagtttattatatgattgtgcttgataacatataaatgtgatacatattgtttgtatgagatatatatatatatatatatacccacacacagatagatgattgctgacaaggagtttctaaagatcatatatatatttttaggtaaaatagaataacattctgcttctggtcttcataataaaagagaaatcaggactaagaaatcaagtgtttattatatagagttttaatttttattcttttatttattgatttatcttctttaggcatgtgcagagatgaactcactaattgttcaaaataaacaatttgaattcaaagcaaagtatatttttggaatatcaattatcacttattgcagataaatgataatataaaacaccaactttggaatttatttgttttacttctgtgactctcagccttctttttaaaatatagtgtatgttttaggtaagttcagacagcagccagcactacatttggtttaaaatccagctttataatgacttcatctttcaaccagccaaagggtagttaccttgtgtctgccatcgtgcatatgctctcagctcctgactgagaaaacatgcctgcaagcacttccctgcctgagattatattaaaaatccatacctgtgctagcagcatgagttcaagttgattattgttctagatctgtgacttcccattcatcctcctaaagatataaatgattgcttttcaatagaccacatacttaggaatgattatgaaggcaaggtttagtaacaataatatacatagtactctaatgggattgaattggaacacccacattaaactctcttaaaatatatggagcagaacacatgagagaaagcaaaagaacaagtgcacacagcagagctgcgagttgcatactctgtgcatgctaataccatcgcaacaacatcactaaggcttctgggtaacgtttgccacatcatattgtgacgtgcatttgtttttatattttaccctaaaaggcaaaataactctccatgtgatgaaagaaggagcacacacaaaaaaaaccctctcagaaatattaaaatggttgcaggtaattcaaatggtatactgttttaaaaggtacttgtctaacactttaagttggaaaagcatcttggaagtcattagattcatatttacattacttgaattgtgaccctagcttgacatttccatggtgggagacatattttatttaggaggcagcagtctatttagtttttgagagcttaatcgatagatggttcagattttctactgaaccaaaatctaaatgcctacccattggttttcgtagccaacgtcaatatccaactgctctttcatacaacatggcttcaaaggctatgtaactaacatcatgccactgcacctatgtctttttaaagccaagtacctctagtgcccctcattatagctcatatttcaaggtatctttcagcaacaatgaattgcattaatcaaactcactttttttgcgtgtgcttcactttatagctcttcacaaataacacatttttcacaaattgaaggtttgtggcaatcttgcatcaagcaagtctattcattctatttttccaacaacgtgctcaccttgtgtctctatttgacattttagtaattatcacaacatttcacattttaaaattattattattattttaaatattttaacttttaggttcatgggaacgtgtggaggtttgttctttaggtaaattcgtgactcaggggtttgatgtacagattattttgtcacctgagtagtaagcatagtacccaacaatttttttttccctgaacctcacccatctctcatcctcctccctcaagcacaccctagtgtctattgtgctgctctttcagtcaatgtgttctcattatttagctcccagtgataagtgaaaatagggagtattgggttttctgatcctgtgttactttgctaaggataatggcctccaagctccatccatgttgccgcaaaggacagatctcattcttttttatggctgcatagtaattcatggtgtatatgtaccgtactttctttttccagtctaccactgatgggaatttaagttgattcctgggtatctattacctaaattacatataaaagcagaaaagaaaaatgacaagtagaacatgaaagttaaacagtatcttttcaggttcaatgacataaatattcttattatctaaaggtataaagtctaatgttttatttcctatagtgcttttatagcaaaacacttttcagaattagataaaccagattgaggccccagtcttactacctattagctaggtaaacttgagctttgggattttcagattcagatcttgcaggcaaataagatttatttgatattacttgaggatgacaatgtctatcttgcagattattatggtaatgagtttatttatgtggattgttttaggatattttaaaactatgtacagacctaaaaaaatcctcataatctttgcagaactgggaaggcatacaggcataatacaactgtaagagttactgtttctcatgcttttgttttctaactgctctggccactgttttagaaggaagggtgaatatatgtaaatattcctgaaaaaataaagttttagaatattaaattattacatatttcattcagaattttttgaaaggtaaaaccaatgattgaacgtagttcatgggatgatctggtccatattcatctaccatgatttaacaaattttttttctcatctattgatgaggaaaaaattaaggggaaatgtagaaatgtaaggtaaatgatctgcaaagaaatacacacaggaggtatgtgggaatgtaacagtgtaggtccgcaggcaaactaggtgaaggaggaaggtgaggaagaaaggaatttaagacttactctttctgttttcttctcaattttaaagcctgatggaatataattttctctacagtaaatgttgaatgaaaatcagttttgtatgtgttaataatgacttcaccaagagcatttgaagctctgtctatcatattttgatgctcaaaataaaacattgtttttatagcttaatagtctcatacagtcaattattgcctcccctccagactgacactttgaacattattattaacactgctgtccttaaaccatcatcggcctgcagtgcagacaatttattgatagctaataaaacagtgttcagatgctgcctgagtgcaggattcagaattgtcataccaatgcataaccacatttgatcttttggaacaagttccattacttaaaaattatggtttcattttcttatttttatatctagattttaacattatatgcatgcctatataagcattaaatatgttattcagttatgtgtgagtgtaactgaaatttcttgtaaagtgtatgtacagtttaatataagacagattattgattaggaaatagttaacaattaataatagacattggccaacctcaattactaaaccagaaaataagtttatttatttattgtattatttttttattatactttaagttttagagtacatgtgcacaatgtgcagtttatttaaatgtattgactgttttttagtcactacacaaatcatctaaaagaaaatacctcagatgaaacctgcagatccactaactagttatcagtttatcaagactgatcgtgtccactcccttcagaaatcacatggatttgtgcattatgcagatcttttttggtcttccccatcttttcccatcctgaactagaagtagaagcctattgcatttttatctggtactttcttttgcatttagtagaaatacatacacatactacccgaggctactccgcagtacattaaaatttccttttgctttccagtaatttcaaatatctcaactaaatatctcagttgaaaaatcaaagttttaattcttatccatctttcaacataaaaacttttaatattgattataatgtgttgcctgcacttttgttttttttttgttttgttttgagacggagtttcactgtgttgcccaggctggaatgcagtggctagatctcagctcattgaaatgtcccgagtttaagcaattctcctgccttagcctcctcagtagctgggattacaggcaagcaccaccatgccctgctaatttttgtatttttagtagagatggggtttcaccatgttggccaggctggtctcaaactcctgacctcaggtgatcctcccgtctcgggcttccaaagtgctggggttacaggcgtgagccaccctgtctggcccagcactcttaatagatatataaatcttactctattaattgaactaagaacatctttataattttccaaatatcatttataattattaaatattaaaacacatttattctgcttagcaaactttgcatctcctcagaatgcctaaatattttgccatatgaaggttccagtggaagtttcagacaatacattttgatggcaaatggtgaattttcctattgagaaatatgttgattacaagaaataagagagacagtagattttcaaaaccttttcaaactatttcagatgaatattcagaattattttacttatagattgcactcttctaaggcacttacatattctgacaactatgtgtttttgaagcaaattttgactgaattaataaatgacagcacagatcaaaatttaaaaacttacaaaattctcaatagatttcacaattgtgcaaagtcccatgctttcttttaatattgtatacttactatacttttaaggggtactttttaacagttgatttattatcaaataaactttctataatttgacagaacaacataaattcttgtttttctcctttctacctagaacatacatatgatagttgagaaagacacatattctgatcatgaagaaataaacacaagttaaatatgactaagcagaaagatggaaggaccaggaacggtgatgctaacttggaaccacgatgcaggctctaaactcctctacaatcatcctcccttgtgagaaaaatacgtaagtcacttttaaaataaatagaaacctgaacacacttcttagctggtttaagtattttaaaaacattgatgaattaaacacagaaatatggggaaatctcattacttaccttaaattttgaaattttctttacagatcatgagttacttaatgctctttcactcctgagtttacattgtaaattaaagttatgtcagctttaaaaaataaccaattaaaaatgatctaaatttatactttaattttaacgaatagtattatctcttattatttacctctgataaagtccaaatgtttgtaggcctatagctctggttatatacaatgaaatatctttctcatgagtgtagaatatctagattatatttaatgcatttactttttgaggaaaaggaaacccttaataaaatagcttcaaatatttggttttaaaaaatgagaaaacaaatacattacaggacttttggatttatcaccaacatgtgaagggctcagaagttgtcattcctggccttacaataataataataataaaagctatacaaattgaaaatcaatgacatttccacagtgggagacatattttatttaggagacagcagtctatttagtttttgagagcttaatcgatagatagttcaggttttctagtgaaccaaaatctaaatgcctacccattggttttggtagccaacatcaatatccaactgctctttcacacaacatgacttcaaaggctatgtaactaacatcatgtcactgcacctatgtctttttaaagccaagtacctctagtgcccctcattatagctcatatttcaaggttttctgttcctgcattagtttgctgaggataatggctttcagctccatccatgtccctgcaaaggacttgatctcatttccttttatggctgcatagtattccatgttgtatatgtaccacattttatttacccagtctatcattgatgggcatttgggttgatttcatgtattagctattgtgaatagtgctgcaatgaacacacacatgcatgtatctttataataaaatgatttatattcctttgggtacatacctagtaatgggattgctgggtcaaatggtatttctggttctaggacttcgaggaattgccacagtcttccacaatagttgaactaatttacattcctaccaacagtgtaaaagcattcctatttctctgcagcctcaacagtatcagttgtttcttgactttttaataatcaccattctgactagtgtgagatggtatctcattgtggttttgatttgcatttctctaatgattagtgatgttgaactttttttttgcatgtttgttggccacataaatgtcttcttttgagaagtgcctgttcatgtcctttgcccactgtttaataggattgtctgtttttttcttgtaaatttgtttaagttccctgtaaattctggatattagacctttgtcggatggataaatagcaaatttttctcccattctgtaggttgtctgttcactgtgatgatagtttcttttgctgagcagaagctctttagtttaattagaccccatttgttaatttctgcttttgttgctattgtttttggcatttttgtcatgaaatctttgcctatgcctatgtcctgaatggtattgcctagattttcttctagggtttttatagttttggattttacacttaagtctttaacctatcttgagctaatttttgtataacgtgtaaggaagggggtccagtttcaattttctgcatatggctaaagttcttccatagttcttccagcaccattaattaaatagaaaatcctttccccattacttgtgtttgtcaggtttgttgaagatcagatggttgtagctgtgtggtcttatttctgagttctcaattctgttctattggtctatgagtctgtttttgcaccaccactatgctgttttgtttacatgctggtttggtagccttgtagtgtagtttgaagtaaggtagcatgatccccccagctttgctatttttgcttaatattatcttggctctacagactcttttttgtccatatgaattttaaaacagattattctaattctgtgaaaaatgtcaatgttagtataaggggaatagcattgaatctataaattactttgggtagtatggccattttaatcatattggttctttctatcacttcccttcttagctgtattcctaggtattttattctctgtaacaattgtggaattggagttctttcatgatttggctctctgcttgtctgttgttagtgtgcaggaatccttgtgattttcacacattgattttttatcctgagattttgctgacaatggggttgagacaatggggttttctagataaaggatcatgtcatctgcagagacaatttggcttcctctcttcctatttgaataccatttgtttctttctcttgcttaattgttctggccagaacttccaataatatgttgaataggagtggtaagaaagagcatccttgtcatgtgcctcttttcaatgaaaatgctcacagctttttcccattcagtatgatatgggttgttagtttgtcataaatggctcttaatattttgaggtatggtccttcaatacctagtttattgagagtttttaaaatgaagggatgttgaattttaacatgaagtgttgttgaaaggccttttctgcatctattgagataattatgaggtttttatctttagttctgtttatgtaatggattacatttattgatttgcatatgttgaaacagccttgtatcccggggatgaagccaacttgattgtggtggataagcttttggatgtgctgctggatttggcttgccagtattttattgaggatttttgcatcgatgttcatcagggatattggcctgaagttgtcttgttttgttgtatctctcccaggctttggtatcaggatgatgctggcctcataacatgaattagggaggagtctctcctcttcaatcatttggaatagtttcagaagaaatagcactggctcctctttgtacatctggtagaattccaccataattccatctggtcctggtctttcattggttggtaggctatatattactgccttaatttcagaacttgttattggtctattcagggattcaacttcttcctggttcaatcttgggagtttatgtgtccaggaatttatccatttcttctagattttctaatttatttgcatagaggtgtttatagtattctctgatggttgtttgtatttctgtaaactcagtgttcatatcccctttatcattttttattgtgtctatttgatcttctctcttttcttattagtgtagctaaaagtctattttgttaatttttttcaaaaaaacagttcctggatttgttgattttttgaagggtttttcctgtctcaatctcctttagttttgctctgatcttacttatttcttgccttctgctagctttggggtttgtttgttcttggttctctagttctttaaactgtgatgttaggatgttgacttgagatatttctgatgtggatatttagtgctatacatttcctcaatgctgttttagctgtatcccagagattctgggacattgtctctttgttctcattagtttcaaataacttcttgacttctgccttaatttcattttttacccagtagtcattcagaagcaggatgttacatttctatgtagttgtgtggttttgagtgagtttcttaattttgagttctaatttgattgtactgtggtctgagagactatcaagattttagttattttgcatttgcagaggagtgttttacttccaattatgtgatcgattttagagtaagtgccatgtagctccaagatgaatgtatattctgttgtttttgaatggagagttctgtagatacttatcaggtccacttgatctacagctgtttgagtcctgaatatccttgttaactttctgtcttgataatttgtctaatattgacagtggggtgttaaagtctcccactattattatgtgagagtctaaatgtctttgtagttctctaggaacttgttttatgaatctgggtcctctagaattgggtgcatgtgtatttaggatagttacctcttcttgatgaactgaatacttaaccattatgtaattcccttctttgtctttttttatctttgttgatttaaagcctgttttctcaaacactagaattgcaacccctccttttcctgctttccgtttgcttggtaaattttcctccatctctttattttgagcctatgtgtgtctttgcatatgagatggttcacctgaatacagcacactggtgggtcttgactatccagtttgccagtctttgtcttttaattgggacattcagtccatttacatttaaggttaatattcttatgtgtgaatttggtcctgtgattatgatgctatctggttattttgcagacttgttaatgttgttgcttcataatattattggtctgtgtactttactgtgtttttgtagtggccggtaatggtttttcccttccatattcagtgcttcctttaggagctcttgcaaggcagtcttggttgtgatgaattccctgagtatttgcttgtctgagaaggattttatttcttctttgctcatgaagcttagtttggccagatatgaaattctgagctggaaattcttttctttaagactgttgacatgaagtccttgcccatgcctatgtcctgaatggtaatgcctaggttttcttctagggtttttatggttttaggtctaacgtttaactctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcgttatttctgagggctctgttctgttccattgatctatatatctgttttggtaccagtaccatgctgttttggttactgtagccttctagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgagattgattcttcctacccatgagcatggaatgttcttccatttgtttgtatcctcttttatttctttgagcagtagtttgtagttctccttgaagaggtccttcacatcccttgtaagttggattcctaggtattttattctctttgaagcagttgtgaatgggagttcactcatgatttgtctctctgtttgtctctttttggtgtataagaatgcttgtgatttttgtacattgattttgtatcctgagactttgctgaagttgctcatcagcttaaggagattttgggctgagacaatggggttttctagatatacaatcatgtcgtctgcaaacagagacaatttgacttcctcttttcctaattgaataccctttatttccttctcctgcctaattgccctggccagaacttccaaaactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgaaagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattatctttttttgttgtgtctctgcctggctttggtatcagaatgatgctggcctcataaaatgagttaaagcaatggaaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcggaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaagtggaaataccatttgacccagccattccattactgggtatatacccaaaggactataaatcatgctgctataaagacacatgcacacgtatgtttattgcggcattattcacaatagcaaagacttggaaccaactcaaatgtccaacaatgatagactggattcagaaaatgtggcacatatacatcatggaatactatgcagccataaaaaatgatgagttcatgtcctttgtagggacatggatgaaattggaaatcatcattctcagtaaactatcgcaagaacaaacaaccaaacactgcatattctcactcataggtgggaattgaacaatgagatcacatggacacaggaagggcaatatcacactctggggactgttgtggggtggggggaggggggagggatagcattgggagatatacctaatgctagatgatgagttagtgggtgcagcgcaccagcatggcacatgtatacatatgtaactaacctgaacaatgtgcacatgtaccctaaaacttaaagtataaaaaaaaaagactgttgaatattagcccccaatttcttctggcttatggggtttctgctgaggagtccactgttattctgatggacttccttttctaggtgacgtggctcttaacaattttccttcattttgaccttggagatactgacaattatgtgttttgggttgatcttctcatggatcttactgaagtcctctgaatttcctgaatttgaatgttggcctgtcttgctgggttggggaaattctcctgaatgatttcctgaagtatgttttccaacttggtttcattctcctcatttctttcaggtaccccaatcagttgtaggtttggtctttttacataattccatagttctctgattatttttcattccttttcagttttttctctaatcttatctgcctgtcttattccagcaagatagtctttgagctctgagattctttcctctgcttggtctattcagttatttatgcttgtggttgcattgtgaagttctggtgttgtgtttttcaggtccatcaggtcatttatgttcctctataaactggttattctggtttacagttcctataatgttttcatggttattagcgtctttgaattgttttagaatatactttagctcagcaaaatttgttattacccaccttctgaagaatacttctatcagttcatccacctcaagcctccacccagttctgtgcccttgctggagaggtgttgcaatcatttggaggagaagaggcattctggctttttgagttttcagcatttttgcattgattctttctcatcttcatgagcttatctatcttcgatctttgaggctgctgatctttggaaggggtttttgtggggccatttttgtggatgtttttgttgttgttgttttctgtttgtttgtttttctttcaacagtcagacccctcttccttagggctgccgcagtttgctgggggtccactccagaccctattcacttggtccctcccctacctggaggtgtcaccagtggaagctgcagaacagcaaggatggctgcctgctccttcttttttgagctccatcccagaggggcactgatgtgatgccagcaggaacactcctgtataaggtgcctggagacccctgttggtggtctcaatcagttagggagtatgtacaggatcggggaccacttaacaaagcactctggctgccccttggcagagagggtgcactgcactggagggaatctcccttgtccagaatgtccagacccttcagagccagcaggcaggaaagactaagtctgctgaaccgcagagactgtggctgtccctccccacaggagttctgcccaggaagatcagagttctgtccataaacctctggctggagttggtgaaattcccacaagggggccccacccaatgagtagggatggatccaggttccacctaaaaaagcagtctggccatgatctgccacagctgctgtgctcccggtctaaacctccctgtctccccagcaccaccaggggaaaacagccaactgatgccacagtgatagcaaccaccccttcccctgggaactcagtcatcttagacagtctccagtctgctgtcactggccacagcctgagcggtgatgagagtctgcacagctctgtgcttggcacccaaggccctggtggtgtggactcacaaggggatctcttgatctgtgagttgcacagatccatggaaaaagcatggttcctcaggaaagggagcacaatcactcactgcctcccttgactgggggtgggagtgccccttgccccatgcagctcccaagtgaggcattgctccaccctgcttttccttgctccctgtgggtcaggccaatcaccttgtcactcccagtgagagaatctggatacctcagatgaaggtgcagaattcactcgccatttttgttcttctagatgggagtcacagaccacagctgcttctaattggccatcttggcacctcctcatttaaccttcttttctcatctaaaggggataaaggatgaaactgtcccaaagaaaagtttataaaccaattaagggagaaaataaaattcaactaggcttgcagaataatcagtggcaatcatgaaatccacttcccaatttggcctacttccttgtagctagttacttcttactcccccaagatagtgtagcccttgtcacaagaatgtgttccttttcttttctatagataagatctaaggcacatgagatgatatgctttctgtttgagtttctcctttatgttacgcatactgataaaattgttgatgccagttgatctgaaggtcccagcaaggagccgactcacagaagaatgcagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaaattatgatgtctcagtgtattggtctattgctgctcagtgggcatatgaatctggcagtcctgtaatagggacaaaagataaactactggcaaaacactcgtaaaagtcataacctaagacataggcccactgaaaggcggatattcaatcagagcactgtagaacatatttctctgctcataccataaaatttaaaccaacatgactccaatataaggagacagacaaaagagctataagaaacagacactgtttgaagatgagtacttaaggaaacctaaagttaagggaggagacaaaaacaaggacactagaggaatttgaaaccttcagaaacttgagctataacaaatattaaatgcagttcaactccaagacagattaacatatatcctcaattaactttatctcagtatcaatttatctcagcatcaatttatctcaatatctattatggataccacatgtctggctctcaacaatggcaacaaaattacaaaacatggtaaaaggcaagaaaaaaattaacaatctgaagagacaggatgatcatcagaacaagactcagtgatgatgatgcatattttggaaatagcaatcaagaaatttacataactatgattaagatgttaaggacactagtggaaaatgtagaaaatattcaataaaagatgattagtataagcagagagatgaaaattctaacaaagaaccaaaataaaaggctagaaattaaaataacgccaatagatttttttaaaatgctttcaatggtttcattagtagaccagacatgtttggggaaagaattggtgaaactaaagataggtcaaaaatacattttaaaacaaagtgccaagaaaaaataaacggaaaaaaaaagtgaaggacatcaaagacccgctgggcagtttctaaagttgtacaaaatgggaaactggaatagcagaaagacaagaaagagagaaatgaggagaatctatctaaatgagtaatggtcaagaaattttaaaacataatgacatgaaacaaacaaccggtccaggaagctcagagaatacaattcatgacaaacaacaaaaatacagcaccagacatagcatttcctatatgtagaataaaataaaataaaataaatcaataaatagacaaagagaaaatcttgacagaatctggaatgaaaactacattccttgtagagaaaaaagagcaaggatttcagcccacttccagtaagaaaccaggcaagaaagaagagagttgcgggaaatgtttaggaataaatgcaccaacttagaattctacatctagcaaaattatacttcaaaagcagaggggaaatcagaatttaccagacaataaaacactaacggaatatattgccagaaaactttcctgcaaatgtgttaaaagaggttattcatggaggagaagagtgatatagatcagaaacctgtatttacaataagaaagcaagtatgttgaaaaaggaaaaaaaattttttatttttcttattgtaaatctttttaaactacatgtttgtttaaagtaatattagtaaatgttttgggcaattacaggatgtgggtaagtgaaatgcctgatggttatgttacaaaagatatgaaggatgaactgggactattctattaacgtgtccagaattggtgggttcttggtctcactgacttcaagaatgaagctgcagaccctagtggtgagtgttacagttcttaaagatggtgtgtccggaatttgttctgacgttcagacgtgttcggagtttcttccttctggtgggtttgtggtcttgctggcttcaggagtgaagctgcagaccttcgcggtgagtgttacagctcttaaggcagcacgtctggagttattcattcctctcagtgggttcctggtctcaccggcctcaggagtgaagctgcagaccttcccggtggttgtcacagctcataaaggcagtgtggacccaaagagtgtgcagcaagatttactgcaaacagcaaaaacacaaaccctccacaccacggaaacggacccaagccggttatcactgtcccttgtggcagcctgcttttattccctcacctgaccccacccacatcctgctgattggtccattttgcagagagctgattggcctgttttgacagggtgctgattggtgcgtttacaaaccttgagctagacacagagtgctgattggcgcatatacaatcctccagctagacacaaaagttctccaagaccccacctcactggggagcccagctggcttgcctagcagatccggcgctggggccgctgggggagctgcccgccagtcccacgccaggtgcctgcactagtcagcccttgggtggttgatgggaccaggcgccacgaagcagggggcagtgccgttggggagactcccgctggccgctgggagcccacgggggaaggcgcgggcggggaaaggctcgggcatggcgggctgcaggtcccgggccctgccccacagcgaggcggctgaggcctggcaagaattcgagcctagagcgggcgggctggcagtgatgcggaactcagcgcatactccgcagcggctggccctgggtgctaagcccctcactgcccagggcctgtggcaccagcctgaccgctctgagtgcagggccgcccccgcgtgtgccgcgcgcagcctcagttcccgcctgtgcctctccctccacacctccccgcaagcagagggagcatgctccggccttggccagcccacagacgggctcccacagtgcagcggtggggcgaagggctcctcaagcgcggccagagtggacgtccaggccgaggagacacggagagcgagcaagggctgccagcacgctgtaacttcttattaaggtacctgcactatatgtgaactggtggagtgctatttgaaggtgatcttagattagtaacaaatgtgtattggatactctggggaaccactagaatagttgaaaaagaaagcatgctttacatgtaatgagtgacattaggtttgataatggatttttagatataatattaatacgaaaagttctagctacaaaagaaaaaatgatgttagagtttgttaaatttaaaatggaattttctgctctgtgaaagactccagagagttaaaagacaagccacaaactagaagaaaatatctgtaaaccatatatctaataaagtattggtatctaaacatacaaataactctgaaaactgaataataagaaagcaaacaaaccaattacaaatgtgcatagaatctgaaaagacacctcacccctgcccccgaaatacccatggcaactggcatataaaaatatgctcagtatttttttttctttagagaaacacaaattaaaacaattgtgatactaccacacattagttaaaatggcttaaatccatgaaccgaagtattacaaattctggtgaaaatgtagagcaatagtagctgtttgctgaagggaattttaaaaatggtactgcacgctggaagacagattggcagtttcttacaaatctaaatatcgtctcaccacgtacttcagctatcattcttctaggtatttatcccaatgatgtgacaatttatatcacataaaaatgtgagtgtttatcagagttcttttttataattatcaaaaatggacagcaacctacatggccttaaaccttaagtaagtgaattgatatactggtacatccagaaaaaagaaataaatataaatctacaggaataaatacatgaatattcaatatttattgctctgtgaaagaaattggtcagcaaatgcctcgtattatatattgctaaatatatgacatggtaaaaaaggcaaaacaatatagtataaaagattagtgcttccagaggtgaggggagaggaagtagggttaaatatgtgaaacatgaaaacaaattttttactgtactgaaactattttatatgatattgtaatggtggacataacattatgcatttctcaaaatccataagagtttttgagcttgaggaggaaacattaatttatataactttaaaaaaaactatcctttaggaagtagagggattgcaagatggaatgcagagtgtgacaaaatattataactgtattgaaaatatatgaaacaacctcactgagatgggtgggaaaaaatgcgttgaaataagtaatttcagaaatgagaggagactgtaaaattaaaggtgaaaggaagtgtatacaagcacagtgctccagttaataaagttgtttctcatggaagtatggtgtaacgtttctgacatcaccgtatatgtacactgtgaatgaacaattaagaaagtgagtgatgaatggtggccgggaacaagtagagggttattcttgatattctcctcaaatttctttaattaattagtaaatgaattagcaagtccctaatggcctttagagtctgctgaaggagatgaataaacagctgactattaatatagcataatataatatagtgtttaatataaacaaagggctatgtgagtgtggaccaagagactattattttcaccttttatctaaaaccttgaaaaagttggcacttctaccttaccttagatagtaagcaagagttagataagttgaaatgacacatttttcatgcagaaaatattacacacgaagacatggaggttcaaaatttccaggttatagggaaattgcaggatgctgaaaaatgcaggttgctgaaaggaatgcagtatgatgcaagatatttgatgttgggcaaaaataattttaacttctattatacagtctgtagagaatgggcaacattgaggggtaacagaagcctttgttactccatctttgaaaaataaataataataattatcccatttagatattaaagattaaataggttagtgaattcaaagtatgccatataaattctggcaaataatatgttcaaaataaattgtaactttgattattaaaacatatgtatacacacacgtacatatatatgtatgtgtatatgtatgtgtatgtgtgtgtgtataacagaattaattgtatatcatagttgaagtaaaagaatgggaagaaaaaatactttaatgggcctccaaataggacaagactatatacatatagtcttgcatatatatatatatatatatacacacacacatctaaataaaatgtatcaatacacacacacacacatattctcagtacatggggataatcagaaagatggctacaaaaatacaaccctcttagttttatataaccctttataaatatataaaactaagagaagaaagaatgccttctgaagcactgtaaactaacctaaggggggtaaagtcagaggattttactatgttggaactgaatttattaacatagttatagaaagagtctgtcaatgaaaggagaattagttgcctatggaaactgagctacagatgaatctttaaggcataaatctcttttccacctaagtggaagtccaattcctgaggcaggaagtctgggcaagtgaaattgccagttaagttggtaagccttcctacaataaaaataaatgcatgtgcacatttatattagcttgatggtgttaaatattctaatcattgaactttatttttctgatctaatacatacccagctatcatgtgactacattttgttttcccatacagatgtgcgtttgggtggaaagtatgtactgtttatgctgaagtaagaattttattttatataacatagttcttgttataaattaataaactaacattctgattgtttatagtcattgtgtgttgaatcgagtctccaaaatgaaatactaatcccaatacttgtgaatgtgaccttatttggaaataggttattgcagatgttattttgaaacagggtcatattgaaatgggatgggccctaattcaatgactggtttctttataaagaaagaaaatatggacacagagagacataaagaaatataaggaagaaggccatgtaatgacagaggcagacagtggggtgatgcatgcacaagtcaaggaacaccaaaaattgctggcaaccaccagaaactagaagacacatgtggaacggactttaagtcagaacttttcagaaggaaacaatcttgccaacaccttgatttcaggcttctagcttacagagctgtgagacaacaaatgttttttttttttttttaagccacctatattgtgatactttattatggcagccctagaaagctaatacaatagtcaaagggaaataaattatctccctgtagcctaaaactttaaaataatttttttttcccagaggccttttctttcatttgttggttttggtttctatacaatagatcaaacatcttcactaatagttttcttagacattatttttggaaacatttttaaaggactcatggaaatctataatctatgctgattgactacttccatgtaaagaatttgatatttttcatagttactactggctgttactgtgctattcctaattgtcttgaatgttgcgtatgtagcatgaaatcccaatttttattgaagtaggatatatatatatataactcttctatggttgtcttcaagccggagcctatttgttagcactgcagggcatcgtgtgtgtgtgtgtgtgtgtgtgtgtgtgtggtagaagctactatatgagaaatgtggagatacgcctttagttcaattctttagctgctaactaatttagagttcttactgttgttttagtcaggaaataatgaaatatatcatcaataaaaagttaaaggaacaaggtgaatcagtccaatgggagaatctaaatcttcccagggatctgtccaaatccataaaaagagtaccatttgataggtaacagcaggggattaaagactgaagcagtttgctgcaggctatgaatgacctgatcccttaatccatctgtctttttatatgagaatgttatgctaattagctgagtaaattgtttcctgatgatattaattttgtgcctttctgttattctaggctttgactttcactgtgataaaaatatacgaaggggcattttcaatttagatggttcctatcctgataaattccaacacagcaatgttgtgggggaaacatgtataaatagcaaacttaatcaatcccgaggatagacatagatgactttagcttcctatataatcattccctttagcttctaaagcattacattaacacacttgaaatgttaaaacataattcaaggagaattttaggaaatgcaattttcattgccccattttctttggagaaaatcaagacttgaattcattaacatggaggaagtaatggaacagatagtcgtgatgtgaaatcctgcaggtgttgtgttctgataatgcatatcctttacaagtttgggtaaattatttgctttgcatataaattaactccaaagctgaatcaacattagaataataaaaatgtagagaatatttttattccaaggaagcaaagatttatagcaaaatatatccaaatcctagatgcaatttcaggaggatagatttaaaaatatttatcatactccaaaaagaaaaaggagaaagaaaaaaggaaaaatacatacaattgagagaaaggaggaatggttttggaaaatacaatattatgttattattgttacattagggagaaaataattgagaatcgatacatttgtttttcagtataaaaacaaaaagatggcacttatttaacaattcttaagtgatgtcttctgagttccactttattgggtatgtattgttcctaagctaaaatctaatttcaaaatattacgtattacaggtgtagtgttgtcttggtctgtgttgtgttgctgtaacaacacttgagactgggtaatttataaagaaaaaaaggtttatttagcttatggttctggtggctggaaagtccaagactatggcattggcatctgttgagcttctgatgagagccacatgctatgtcacagcaaggcagagaaacaaaatggaaatcaggcaaatcattgctttataaaagaggcaactttctttagaatgaccggctcttatgagaactaatccattatcatgaaaaataacccagtttcaccagaaagttattaatttgtcttaatgacctaatcacctcttcaaagcacgatctcctaacaccttacatgggaaattaaatttcgacatgaattttggagagaataacccatgtccaaactatagcaagggtaaagaccccaaatttacttagacatggggattaataatcatgtgtcattgccaataaacgttttctttcttttgcacttccaaagaattttttcaccacctattttcctctatgtttttctttctctagtatttctttctctaaaaatttgtgcttgtgtaaataatttgcaaatgcaacttttttcttctttgaaatgatagctaaattcaaattacttttatcttattcaaaattcagagaaaaattcagaagtgacctattagatgtttgagaatgtgctatactacatcaggtgcacaagttcctgtgaataagaagcaaaaaagctagcactttccccacttctgtttttaaagaataagcttatcaatggatattgaggaaaaaaactactggtaatatttaaatggtaaaatgggtatggtaaaataatattacgagcattttttcaagtaatacattttgaactttaagttttcttctgttaattttatctgtttataggagtaatcctgttttgttcacttcagtatattcactattcctttcccttacagtcaagcattggacatggccttgatattgctggtgattacccatagggctcaatgttcatcttttgtttctaaattccaaaagcaaagttgattctaaaggatgataataatcattaataattcatagaatacctatctccaaaacagaatcaggaatgctatagacaataataagcacacattaaaccaactgggcactgtgcccagaagatcagccaagtacacacaataggcaagaaaagagcttgtatgtgtgtaaggagaaataagaaagggaaagcaacgcgtaaaaggcttccaaacagaacaaccagggagtcaacagattttcaaactttcacagaaaccagaaatattttgaagtcatttctgctgggtctactaactgtcttacaatgtaagatagccatgaaccccaatggaagaagtagaagcaaattgagtatattctaaaaaattcaaaatttgtaggcatattaagttttaggttttacaagcttacaagtggtgaattacaagaccacaatataggtgtaggtttatgggcttttttatttgtgatgatgacttaaaccaaccttcttttttctatatgatttgttgaaattaaagcactgtacatgtgattatgacaaggaacaaggagtctcatgtatatgttttcttatattataaaacagcacctgaactttttcatgtcagatctctgctggcaaattaaaggaggaaaatacccccatgaactgaagaaacctatggaagttagcttattgaaatgctgccagagtcttcatttagaggggtttttataggtagtaggtctaaaggatactagcaaacaaaaaatgctaacaacattttttttcccaagggagaagtaccccaccaaatttattccatgtaggcctgagggttggatactaatttacttaccatgtatttattataaaacactacttaggcaggtgtgaccaagctataattggcaagaaaccagggatgtacatttgcttttgttattatagctaaactagaagaagactaaatcctttaataggaataaaaagttaacacaatgatttaatttagttctacttagtatagataacatttggtagagcttcaggaacttactatatattttagcccttaatttgtaatgaaggcattgacagtataaatcttgggataaactaggtaaataaattactttttttgaatatgaatgttcttttttatttatcctggagtcatattcagtgaagtgagaaatgcattttgttaaactgacacctagatttcagggagaatatactcaaatgataaaatatttatatcaagaaaataacttttactccatgacattatattatttatcagatatgagtgtcattaaaattcattttcaaactgtgtaaaagagaatgattcctatgccaatgttttcttacagtgtgaaatcttatattgataaaagtacaatatttatatatgaaattttggaaagctttgagcataaagttctcagtcacatcataacattttctctgacagtgtgtgtgtcttagggtagggaaagagagtggttgaatgtccatatcttactaactaagatggtatgcccactgtcttaacaatttacttcctgtattgactcgactaattaggctgccataactttatttcttaattgttaatatgttggggaaattatcaataagtatagaaaatgacaaagttattgtttctgaaaaactatgaaaaagaggatagccttacttatgcagagcctattaaaaagagagtactttttcttcttaaaatgcatagcttgaccagctccatttaacactgttttttaaaagatgtgttaatatcctaatggtataaatgaattcagtcatgactagttgagtcaaagagatttaaaaattatttgaactgttttatcaaatttctagctcattgtttagtgctagatattcacaaaacaaatagttaagttcctaagattattgttgcaaactgtgggaactaaaagtctttaattacattactttgaaagcaaaaagtgatttccatgcaaaatattttaaaggatttctacccaatgtcaaattttctcatctattcatttaataagaattgattaaatatctgttgtgtcttaaaaatcaatgacgaataacatcctaaacttcagcaagcatatggttgaacactaaataaagaacaaaaaccaaggtaattacagtagagtgtttcagtgatatattaccaccaagaacagagagctataaaaatcactggaagaacaactaactgaatctttggggagtgaagaaaagctttctttggaaaataacctctaatctcatatctaaaggaccagtaggagttatccataaaaaggagaaagaaaattccaggtagttgaaatggcttgctgaattgcaagggcacagattactaaaatgtttagtaatactcatggtaattttgtttatatttttgaaacagatatcatgtagtcaacacaataggtcaaatcaggacctttggtacacataaccctttttctgtaaggtgttgataggtatcatttgaataaaattggtgatatttagtgtttattggtgtttgggaaaaacatgtgcttcctaaaattttagcatattttcctatatgatttctcattaataaattaatgcacaaagcaaatatccaggaggtgttaatagtaagcagtaatttccaaaattgcatgaccaagaaactttttactcatagaataactgaaatacttttctcaggaatatactttgagaaatattgcttaaatacatgtggaaaaaaagtgttctaaatccaagttctttatgatggagattactgaatccaagtgttctaaatccaagttctttatggtggagattactgaaaaagtatgggagaaaattatacattttgatagaaaatcgtaagagttgaatggtgtttgcccaaaaggtttgtccacccagaatctcacagtctgacctcaatcgtaataagcatctttgaagatgtaataaggtaataaagtgtgctcatcctctattacaataaattctaaatctaatgagtgtccttataagagatagaataacagaaagacacagaaaaagcggggaggcatgtgaagacagagtcagagagactggaaagacaaaaaccgctaagaattgctgacagcatggaatgggttttttctgggtctccagtggaaaccaatactgccaacacattcatttgtcttctggcctccagacctgtgagagaatcaatttctgttgctttaagtcatcaagtttgttgtaatttgttatgacaaccctggaaacctaatacaacaatgtgatgctttagaaccagttgtgttcgaacaaatttaagccttaactcatattcttaccaaacagtccccaatgaattatggatgtcctttgatttcatgtccttgcattatcctcccaaccagacaatagattagccttgtgaattagttgagccatgagaatgcagctaaagagacactgtataagtttcagtcctaggcttaaggaagctttatagcttttgtttactctgtcttttaccttgagccactgtgcaaagatgtctaggttagcgtccttgtggatgagacaccttatgatgaaaaagaccaggaggaatgaaagactgggaagatagagaggaagacccagttagtttctagtcattccagcacaacatatgaatggggccagctaggatcctccagtccctatggagctgcctctaaatacaaacatattaaatagtccagcagaagacaccatctagggaagagatgagccacccagctgagttcagcccagattgaagaatcatgagcaggtccatctgtgctacttagctgttttaagctgctatgtttagactggtttattatgcagcaatagaaagctgtaaccatctaatatgattatcaagtatgtgtttttaaaacaaagacaaaaaagatgaacagatataagattaggttgtgtgctgtagcaaaggtggatttgacctttttttaagttaagaattttgataatctaccatacatttttaaattctttcttgcattaactttatctctggataaaaaattcaggccacccgtaagtaaatagaaacagtaggcataaatacacaaaaggaaagttatattaaaattctgcagaaatgtaacaagaataaaaaagctgaactggatttttaggatgttctacactcagcttttatgagaaacagacaaatgacaatctcatgccaaggatttgttttaaaaggctgtataacaggtagaccattgactaacacatgttttaccacctttatcttcagagtactgcagacaaatgatattcataatgactctacacgatactgaaatggtatctgaatattaacaactaaattctgaccagttatgatttaaaacatttagctatttattgattgttatttttttaaaaacttggaatgtgcattatatgtatatttaactataaagtcactgaacatttaattaacatatgtcctgtttttcaatcattactaggagtaatctttatagaaatacaagtagcaaccattaccacaaatgaattctcataagaaacagttattcaagtctttttctctctctctttgtcaaacgcatgtgcacacacacacacacacacactttgtatgcctgtggattgtgtgagagagagaatgagcctgtaaatacagaattatatcagaattcttgtagcaaataagctatcaggaaaattgagccaacttagtcttggtcttgtgaaggacattttctcttttctgacctagtcttttctattaagtgaaagatgtcacacaatgaccactcatctatttttgatggatacatgaattgtacattacatggaaagaagagagaaaataatcctaattttatataatgtacaggttagaaagcctgatacagactaatataaaattaatgctttgaataaatttgtttatactattgctctgttagtgttgctacttttggtttgtttttcaattgtttttccaatatgtatttagtttgatttttaataatcttctctctctcttttttcttttcttctcctttacctcttgctcctcttccttactctccttgccttcctcctcagtctcctcatcctcatcttcctcctcatcctctttctttgttttcattacaaaataaaataagcaatcagaaaagttcatacagatattgttacttatctttagggacctggatctaacttagtgctgttgcttctgtttcttcccttttgtcctcctcttctttttctcctttgtgttctgttttactttttaaaaatagatgccacaactctgatttttaatctgattgtgtaaatgatccttaatagtaaaatcaattttaatatcttataaaacagaagcacagcaaagcattttgcagaatttaccataaagtaaataataaccattcctagtatgataatgctgcagcaatttttctttcatcctctgcaacatttttatctgacacagtctctgctgtttccaagttcaacgtcctgcagcaagccttgccagcaatacagaatactttcaattagtagttctctacttctctggtcgctaagcaactgacctgtggtgaagaatacataatgatctgcatagacaccttagagcaatagaaagtataagcttcacaagtttcatttgctctcttgtgttgatgttacaataaccagttaaatgcatggaaatatttgatagtagtttgctataataaactttaataaagattaaaagaagccttggagaaaggtagaaataaacacaacataaaatattgtatttgtcatttgttcatgtatgtcattttattgtttatagggagggcaagcaatcaggttaatattttattaaatgtttatattctagctactgtttaagacagaattcatcaagtagcagaagtgatggaagggccaaggggaagaaagatggacaaaacctgaaaattgaaagtgcaataaaatgaaaattacaaatgaaaaccagtatgcctgagttatacatgactgtttagtagagtgtcttcatgtgggttaaagaagaaaaggaaataccagctggaatcagcagaacagatttagcacttgacccttggatacttttcattctatttatctatcatatttttattggtttgtattccattgactactatatgcaccgaccctcagcaaattcattcaatagagaggagagattatatctccactgtatcagtggagctgcttaggaacatttctcccgcttcttgcatgtattttgtcctatttgtacattgtattttatgagctgctttagaatagtagaataactttcctttatatggtatagaacttttgatatatctcaaataaatttttaaaaaatgatcaattgaaatgtatgttctcatactgtatgtgcaaatatcagtagtacaaacactaaggattaatgaaaatgaaaatcctaatatattaaacttagaaaaatagactaaatatttactgaaaagaaacagataaccaaaatttcgtgatacacaatgaaaagccttgagacattaaagaggactttcactgcctttgatgatgtcatcctttacctattaagttcttctagcatggtaactagaactaaacttttaacttccttttaaaccacacactgaatgcatctgtgaaaaagacctgcatactacaaggtaactttaattacatatcttctgtggggtccgtgcttttagtttagtataggtttatgcaaagtgatactattggtaatgtgtaatttaaacacacacacaaactaacaggccctgccgcctatcaatgtctgggtgatatcagagaaggccgtgtgggaatctagaactttcttctctgccaggtagttacaatgtgccccgtccttctccaccagattccttaggtgtcaaagtaaactaagtgagaagttggaactttcaccatcatctagtggtaaaaaggtccaaggcctcctgatgtttgccttcccttcagtgtaggccatagtgggagcagaaacaagaaaaaaatcccccactctccaaaggtggttgagcagggataaatttttatcaccacctagcaataacaaggcacccccactttcaccatgtgtggtgtcacaggaggtttatttccaagagttaaaatacagagcctcatagcataatatccaaattaccctagatacgttgaaaattactcagcatatcaagcaccagaaaaaaaatctcatcttgaatgagataacacatgccaacacagtgataacacataaattagatttattcacaaggattttaaagccaccaccataaaaatgttttaatgagcaattgcgaatatgctggaacaaatgaaacaatggaaagctttacaaagaaatagaagatgccaagagacaaatagaaattttggcaccgaaaaatataattgaaactttaaaaaatacttgatggctcaatagggtaatggaggaaatagagaaaagaataagtgaacttgaaaataggacattaaaaatttactaatccaaagaccagagggagtatagactgaaaatgaaaaaaaaaaaaagaacagagcctcaaggacctataagactatagcaaaaaatctactattcatgtcatcagagtcctagaaggaaaggcaaaagtgggttgggctaaaaatatatttgaaaaaataatgtccaaaacgttttcgagtttggcaaaagacatacaactacagattcaagaaatgagaaaatctaaaacgggacagatacaaaaaaatcaacaaagaaacaggtcaatttcagaaaacagcagaagaaaaaatcttggaaacagtgaggtaaaacaatgcttcatctctccagaagaaaaacaatttgaatgacaatgatttcctgtcagaaataatggtggccaaaaggaagtgatatatttctcaagtactgcaaaacaagaactgtcaatccagaattctgtattaggcaaaaatgtcctttagaaatgaaggagaattaaataaattctcagaagaagaaaaattaagaattggttgcaaacagacctaccctaaagaaaagcaaaaagttcttgaaacataaaatgaataaggggcctgaaatcatcagaaaaatgtaagagtaacagaaagagcaaaaatatgaataagtacaacagatttttcttcttgagttttctaaattatgtttgacttttgaatcaaaaactgtaacatcgaaatggttatcaatacctaaatgaaaaatttttaaaattatataaacaaggatgggtaaagagacttccaacgagataagatttttacacttcactagaagtgttagatattttgatagtggtagtggtcacaagaatttacacatgtaataaaatgacagatgtatgcatacacattttttcaatgtcaatttcttggttttaatgttttactgtagctacaaaaaaaatgtaaccactggggaaactaggtgaagagtatgagagacctctctgtactatatttgcagccttctgtaaatctataataatttcaaatcaacagttaaaaaataaaaatatatctaatagaccaatagtttcatatggagggcagaatgatttaaaaaaatgagatattttgtttatgcatacctgtaaaggcatccatgaaaggtattattaacatttgaaattatgtaagtccaatgctgcaggaacatgggcatactatagcttattttagatgctttagaaagccaaagtcatctctggtaagttctacattgatgataataacctgagagacttctcagtctccaaaattgcactatttctaaaatataagtaaatattcccttcatcctaaatctttcaaagtttaagaatgtcattgatagtcttcgctttagaggaaaatacagagatcaagaaaaaaggtctggaaaaatgaaaaaaataattttaaaagcttcctcagagagaaagagtttcagacggatatagtttaactatattaactcagccatgaatttcttacttctcttctagtaccggttactcttttgctgaatgaatctaccttatgaacacaagttaaaaaaaatgtacccatgataagtaaaacattattaaatacagctatttttataaaagtttcaagtcaaaaatggatccatttctgttcttcttcttacagggagttgcttatttcccatccttcattaaaagggccaaaaagtatactcatctgtagtagagaatatgcataatgtttattaactcatgcttattataatgttaacacattatctgccactccaagaatgtgggcatatttagaaaatgttcaatatggtatctataaattattctatggcagactttgatttaattcttttcatcttcatttaataacagtggagtggttcttaatatcatattttcattatttgcatgtcctttgcaagaaggcttgggaacctatttaccccaaaataagttccaaacaggtcagacttctaattgttcatacaaataactaaggattagaaatatagatgctatacaattctaatataaatcttttggtattaacccctcaccgttgaaaacacattaactgacttgtagtgtttgatcgtttccacacaaagaagatggatcactgtatgtctcttaatatctacatagccttaaaccagaagatagaacatgattgttcaggagagtcacatgatttcaatcaaattattgtaagtatgtcatttgagcagaaataacacaatgtgcagaatactgcaagtgaattttcttttcgccaaatagtgtgagctaaatcatgtttactatagtgataatattaattattcgatggatatgctagaattattctactgatcttatgttgttttctgaccacattttccaaaacactttaaattgtgctttaccctttcatacccttttattgtttactgattcattccacaaattaaaattaactattggtactaatgtgtactgaaacaaaaaacaataatgtcacttcagattgtgactgattcttaaaatattctccatggtcttcatggcctaatggttttaagttatacacacagtatttcacttaaaatattatggaaagcagcacctggagctttaaacaagttacttagtttatatctgtagtttataaatcatgatgtgttaaactttattatgatcttacaatttgaatttaattcttttataatgtctctaggtcctcctgatgatagatagatagatagatagatgatagatagatagatagatattttccttttagaaaacctcttgtttttctcatatcccactctctgacagcattatattcaagagcaagggtgggaaatgtgtttactgccaaggtattagatagctaggttaaatgccaaaattaaactgatataaaaagtaatacagaaacaagaaaaaaaagtggaaaatgaaaacataaccttgtaaagtttttattctaatatacaggtatgttaatgaaaataatagaatggtttctgaaagacataaatggacagtattgttttatgaatacatcagtaagaaaatactttaacaggaacgggaaattctccaggttcagtgtgagatttccacctataattttcatttggctggcgagactgacttgcgttacttgagttatgctattttaaaagtatttgtcaccagtatgtatcccttctttgatatttttcctcccttctacagtgacttttaaaatccaaatctaatcaagctgccactgaggacatattgttatattaaacatacaaatgtttaagccttattaaatacagactgggtttcagtaaatcagaaatggttaaacaaaacaaaacaaaaaaaaagaggccaggcgcggtggctcacgcctgtaatcccagaattttgggaggccgaggcgggcggatcacgaggtcaggagattgagaccatcgtggctaacatggtgaaaccccggctctactaaaaatacaaaaaaatagccaggcctggtggcgggcacctgtaatcccagctactctggaggctgaggcaggagaatggcgtgaacgcgggaggcagagcttgcagtaagcggagatcgcgccactgcactccagcctgggcgacagagcaagactccgtctcaaaaaaaaaaaaaaaaaaaaaaaaagtggatgaaaaatagtataaaaggaattactccctaattatttatattgtgctaaataaaattcccagttccaaaaccaaaatgtaatgactgcaccatttttcactttttctagatgtggtcagagactttaaatgagagaaatgatacatgcatatacttggagagtaataggtattgctgaataatataaagtttgagaatacacttttgcttaaaacgtaaaattggtgatttatattattttatttttaaatgtagaaatagctaaagtataaattttgtataatgcaagtgcttttcctaggttttagttttgttttaatttaggagtaagggtaaagaagctatttataaatagtactaagtccgtgtgttcttttctctaaatacatcttgatgtgttacgaagatcaaatgttctgaaaaagcaaatttcctctaaacctgagtcctctctttcactagcagagagaaaaagtctctgctaaagttactggatgaaaacagaaactgtatacttgactctattaaaggaaaaaataaaatgttttttataatattaagtcaacttgaaataaaagaaaaaagttagctattcaggcctgtccctaacatttgtggaagttcagaagtattgcaaatctagacccacatattaatgactacatatttataagacatcaatcaagcttaagaactgttaaagtgtattgaaattcctacattgacaacttcataacaacttaaaaaattaaattgaaatctgcattcttggactgccaagagaggtccacaatggaatgtgaggattggaaagaggccccaggtcatagccaatttcattctctttccacccctctttccatcttgctggatgaggggtttgttacatccaagatactgcagcctatttgtccagcatctcctcatgagacatccctttgaccaagggttgtacacaccagtccaccttcaaaaaggctgatgtagggaatggccttgaatagaccttgaaagcaatcttaggaccttttatttctcctaaagaggaatccagagtcttgagtattggtacattggcatagcacatggatgggcatgagtcttgtttcacatgagcacattcacttgttttgtggactcatcgccacttccccttctactctccttcccagcccccatgggaggaaggtgaaagtggtttgtggttcactctaaagggctggcctagaacctgagttcctcttccctttagtctaagtttagcactgcaactatcttgttccactgttcacatttaccacgaaatgggtcaaacatacaaagagagcctaaagacacttttaatacatattcgtaaatgaaagtttattaataaaattgaaggagacgtatcaacacatagtcacttcttttctagaaaacactccctactttatagaattgctatgtgtatagttcctcagtaagtgctatgtgtgaacagaagatgtagaatacagatcttttatcttcaggtcacttaatatccaagtctgaacataagaaacataaacacaaaaaagtaactttcagaaaagtgctatgcaatatatattggggatcttctaaggagggagatgccatcgtggactatgatgatcaaagaaaggttaatagagcttcctattatgtgatactcttcaacaatatggggaagaggaaaagtgcattatggattattcaaaagacaagtgcaaatttggtgataagcatagaaaacattcagaagtatagaatgcatacattagacagaataatgtgattgtttcagaatatttgaatatacaattagaagtaaatgttgggacaaattatgaaggatttagaatattagatgtgagaatttgaactttattcataaataatcaaaaaaagaaaatgattgtaaattgctcaaaaaagggctatccatcaaaaggagagtcagggaataacatgtattttgtgcattcaaaaaaaaaatcaaaagactgtcttccactttcaccttttaagtgtaagggtcacagaaggtaaagaaagtagaaataaatttgagaaatcattgaaaaaaagaatttaagtatatgagtaggcataggcaaaccaaggtaatgacaatgtctgtgaccacaaatttttgatcagtttgacaatagtacctttgacataaataggagaaacttgagtcaggaactttgtcctttactcatagcacctggcataagagctggagccagttttatgtttttgctagtttttgtttgttttctttatacataaaacaaagtgaaaaatgaaaatggccagaaaaaagttggaaatttgagactggatctcaggataggtattatgatgtatttttagtatactcatttacatagagatgatggtttacactattttgagaaaaagtaatggtttagatggaaagttaaaaatcaagaaaagaaataaagcattagacagaaacaaaaatattcaggataggttcatgttatagaagccttaaaaggacaggttgatagattttaaaaatattacagtaaataataatgttagaaagaaattgatcacaaatttctcaccaaacatgctatcacaatcagattacctcaaaccagaatgtaatcaaaaccattgcctctttctctaacaacaaagattactatttactactgctgtagcattttgataccttcaggtctataggaaaggaataaaacaccaaatgattctcagcacaaaaatggataatgaatatccatttattgttattaaaataatgggcatgattatgctaataggtaacattctttctttagtatgaaattgcattgtattgtgtctaagaaaaagtgttggttgtttttgcaaagtataattcaggagattaattgtattcaccaatccacagttttcactaatgagaagtgaactggaatttgaaagcacatacacttttccccttaaacaattgcccactccattttgcaagctgagaaatggagaaagagggatatcaatctaggtaaagtctgaggtgctacttgtattaacaggactcaggaatcaaaaatctgtacttcctcccataaaaaggggtgcgattttttcctgtagacagtgagttaatgtggctgccttcaaaggcaaacagacttcaatgtgactagaagaaaaggacaatggagtgtccccaaaagagaggcatgttttttaatgaatgaaaaaccagagatacttttcaaaataatagaataacatggcttagttattttcattacattacaatacatttagtagactgtcctgtccttcagaaataagagccacagtgaaatgacaataatacatagtaacactttactatgagcctaacactaaaaatattactttgtatttattgttttatttaattttcacaaaaatataatgcctgtactaccaatacacacttttgcagatgagaaaattgtatcagaagatgtaatgaaattcttcaactttacatacctaataactgctaagattggcatttgaatatactttgtctgattttagagattgtgaccttaaccactatgtcatacttccttcctgaagtgttactgattcacatagacacacaaatctgggcttggctaggttccttttcccaaagagagagatgggaaaatctactccttaaatggactatcaaaccaaactttagatatcttagtcacagaatactataagttagtatattttatttcttagtaggttattaatgaaaaattttaggaagaaacttaaagcataacaacacattgttacaatagggagttagagatgaaatatttttaataaaggaaggactatgtaatagtagccatatcaaggaggtcttttggaatggactagcatgagtctgcattagtacaggaggaaccacagaggattaacagcttaaagctgatagagaatatttgatgctagagataaaaggaattgattgaatttaaagttctagtggaaaagttagtctggacaatgggcactgaaaattcaagaatgggtgatttcaaatgtaggaaaatgtgagctaggatgatttataggtacataaaggagctctttatagatggtcactgatggtttcaataaaatagaaatgagttcatttgtcaagaataaagaaattgggaccattgggagcttaaggtgattaggcaaagcttggcatagatgctgacagaagtgtatcagaaacgtaacaggtccaatcttactgatctacctttattgattcatttgtttacttgttcattcactttttatttaacaaagaatttagtcataacattttatattatatttatgtatatatttaaattatatttatatttatttagctccccaccccacaacaggccccagtgtgtgatgttcccctgcctgtgtccatgtgttctcgtttttcaactcccacttatgagtgagaacatgcgatatttgtttttctgttcctgtgtatttttgctgagaatgatggtttcccacttcatctgtgtccccaggaaggacatgaactaatcctttttatggttgcatagtattccatggtgtatatgtttcacattttctttatccagtctgtcattgatgagcatttttgttggtcccaagtctttgctattgtgaatactgctgcgtaaacatacatgtgcatgtgtctttatagtagaatgatttataatcctgtgggtatatacccagtaaagggattcctgggtcaaatgatatatctggttctagatccttgaggaatcaccacattgtcttccacaatggttgaactaatatacattcccaccaacagtgtaaaagcgttcctatttctccacatcctctccagcatctgttgtttcctaactttttaatgatatccattctaactggcttatgccagatggcatctcattgtggttttttttaattatactttaagttttagggtatatgtgcacaacatgcaggtttgttacatatgtatacatgtgccatattggtgtgctgcgcccattaactcatcatttaacattaggtatatctcctaatgctatccctcgtccctccccccaccccacgacaggccccggtgtgtgatgctccccttcctgtgtccatgtgttctcattgttcaattcccacctatgagtgagaacatgcagtgtttgtttttttgtccttccgatagtttgctgagaatgatggtttccagcttcatccatgtccctacaaaggacatgaattcatcatttttatctcattgtggttttgatttgcatttctgtaaagcccagtgttgaatttttttcatgtgttttttggccacataaatgtcttcttttgagaagtgtctgttagtatgcttcgctcactttttgatgggattgttttttttcttcttgtaaatttgtttaagttccttgtagattctggatattagccctttgtcagatgggtagattgcaaaaattttctcccattctttaggttgcctgttcactctgatgatagtttcttttgctgtgcagaagctttttagtttaatcagatctcatttgtcaattttgattgttattgcttttggtgttttagtcatgaagtctttgcccatgtctatgtcctgaatggtattgactaggctttcttctagggttttaatgttttaggtcttatgtttaagtcttcaatgcagcttgagtcaatttttgtataaggtgttaaggaaggggtccagtttcagttttctgtatatggctagctagtttcccagcaccatttattaaatagggaatacttttcccattacttgtttttgtcaggtttgtcaaagatcagatggttgtagatgtgtggcattatttctgaggcctctgttctattccattggtctatatatccattttggtaccagtaccatgctgttttggttactgtagccttgcaggggttgcaaacctagtatctgataaaacagactttaaagcaacaaaagtgaaaaaagacaaagaagggcattacataatggtaaatggatcaatgcaacaaggagtgccaacgattatatatatatatatatatatatatatacccaatataggagcacccagattgataaagcaaattcttagagacctacaaagagacttagactcccacacaataatagtgggagactttaacacctcactgtcaatattagacagatcaagaagacagaaaattaacaaggatatttaggacttgaactcagctctggaccaagcatacctagtagacatttacagaactctccaccccaaatcaacagaatatgcattcttctcagtaccacatcacacttactctaaaatcgaccacataattggaagtaaaacactcctcagcaaatgcaaaagaatggaaataataacaaacagtctctcagaccacagtgcaatcaaattagaactcaggattaagaaactcactcaaaaccgcacaattacatggaaactgaacaagctgctcctgagtgactactgggtaaataatgaaattaaggcagaaagaaataagatctttgaaaacaatgagaacaaagacacaacataccagaatctctgggacacagctaaagcaatgtttagagggaaatttatagcactaagtgtccacaggagaaagcaggaaagatctaaagttgacaccctaacatcacaattaaaagaactagagaagcaagagcaaacaaattcaaaagctagcagaagacaagaaacaactaaaatcagagcagaactgaaggagatagagacatgaaaagtccttcaaaaaatcaatgaatccaggaggggtttttttgaacagatcaacaaaatagatagaccactacccagactaataaagaagaaaagagagaagactcaaatagacacaataaaaaatgataaaggggatatcactactgatcccccagaaatacaaactaccgtcagagaatactataaaaacctctacacaaataaactagaaaatctagaaaaaatttataaattcctggacacatccactctcccaagactaaaccaagaagaagtcaaatccctgaatagatcaataacaagttctgaaattgaggcagtaattatagcctaccaaccaaaaaaaaaggcccaggaccagacggattcacagccaaattctaccagaggtacaaagaggaactggtatcattccttctgaaattattccaaacaatagaaaaagaggtactcctccctaactcattttatgtagtcatcctctttttaaagtacattcttatcatgataaataaaataggaatttcttggtttattttatctaattattttatcttgccctaatctctaatctctatttttatttccttctgcttctccctcttacttcaattgcattcatgtgtttgtggtagacccttgaatatgcattttttgaaaactataaaattttgtggttgtttttgagttatatgttgtatatatagtttttacttttgtaaatccaacactatattattaagacctattattgttatcgtgtgtatctttacctcatttttttttcatgctgcacagcacactattacttcttcttctttttttttttttttgagatggagtctcgctctgttgcccaggctggagtgcagtggcgtgatctcggctcattgcaacctctgcctcccgtgttcaagcgattcttctgcctcagcctcccgagtacctggaactacaggcgcgtgtcaccacgcctggctaagttttgtatttttagtagagatggagtttcaccatattggacaggctggtctcaaactcctaaccttgtgatctgcccgcctcggcctcccaaagcactgtgattataggcatgagccaccacacctggcctgtattccatttttataaacaattgtgtgtgtgtgtattacagtgatagattctttgcctccttccaactccctgcaacaacaattgtctctactggatatcatatcctttcatgagtttaaacttaagtttatttgccatgtggatcaagagtaggactgctggttcataggtttggatttcatttcactccacattgctctctggatagttgcatcagtctgtactcccatcagcagtacatgtgaagtctagttttctaaatttaaaaaaaaatttgttattatttgaacattatcttccatctcactaatgagcactcctcaaatttaacccttctgctgtttataccatatatttaatccttcatttcaacagatatggttttcatactgaaaaaatattttatgattgctaatttcttcttcaggttcaaatattgtgccttatgtctttgagaacatttactatacatatttttggatttattttaacttttttttttcttcagagacagtgtctttcggttactcaggctggagcaagtgcagtggtgacagcctcctagctaactgcagccttgacctcctgggctcaagagattctcctgcctcagcctccttggtaactgggactacaagtgcatgccgccacacctaggtattttttttaattattatttattttgtagagacaggggctctcttggttgcccgagctgatctcaaactcctagcttcaagcaatgctcctgtcttggactcccaaagtgctgggattacagatgtaaaccaccacatatggtcacatattttaaactattgttaatttttgtaaatctggttgtctttgatatacatgtattttattttagagtcattgaattcctttgaggcctattttttcctagtaagatttattatgctgattaagaatacatggcactaaaatcaggctcaagattgacccaccagaagtgtttagaatgaaggactccttaggaaataactggattctgccaccctttgtttgccttcctcctccataaaagttggtgtattcacgtgtcctgggtggtgctgtttaccaagactggtctccctcagttttaatcaccatcctaacactcattgtatggagtagctgggttagaggagaatgcctagggttcagatggtctttctgcatttgtcactatttcctcattttccaagctaggttgagtcatattctgcctggccgactccaaaatggctttaaaggagttagcagtggtctcttttcaactctagttttgctagaatgggagctccatttggtcaaagttttgtctttctggctctgtagtgtattctcagtatttagaagagtgccttgcacactgtgggtactctaactattgaaagagcagaaaaaaatacaggaatgcaatgaaaaggaatgatgaccactaaaaacttccgccccagcatattctggtttccttacatctcagttttctgctctttgctgtcatttttttctctactcgcagactttactgtagtttgtaactgcaaaggtttctcacatcttttagtattagatgctgatttctgtgtcatttccagggttgtggtcacagaaagaagcccacatcatgttagttctccatcttaccagataaagcttagcttaatgtacttctatgccaatttctttgaataactaaactttcaataatttaatcaatcactgattaatccaagatttgtctcagatggggcacaacttccacaacctaatgtagcttccacaacctaatttttaatccccaaaaatgaaatttaccaattattttgttaaatcatacaaatataaaaattctgaacagtgaaataaagaaagtatctcaaaagtaagagtactcttggacaacaatagctaaaaaagtgtaacaaatatgaaaatatgcaggctctgtttctgacctttaatcattctatacttctggggagcagttattttgagactcagtttttacagaagtaaaatgggaacaaaaacagttcctctgcctggctcatagaatttctgtgagaataaaagacaattaatctttctaaagatatattacatatattgtaaagtaccacaattataaatacaggagaatacttgcttctcttcgtatccatttttctgtttccaatgcttgtttggtttttaaaatttaatagtattttcctgctactcaatgtttgactactgaaattcttatataaatgttttctgcaaaaaaattttatggacatagaataataattgtatgtgctcagttgcttgattaaaatactttattgtgattattttgtaaagaaaagaattgcactataatttcgatgttgtgcaaattataataattaaatatttaggctaaaaaagataatgcaagaaggctaagttgtattgtcatattgttaagattactttttatttaatgttcctaatcagaagtgaaccattatctatgtaaaaataatttaattcagaaaattttggtctcaaatttacataatgccatcattatcctttttatgttctggaaaatttattctaaattacctagaaaaaaaggttgattctatagtgttattttttattctctatatctcaggtaagaataaagggaaacgagtaagtaaaggaaaaacaaagatgaaaaaggaaattgtactcaagtcacatagacactgaagtctcagatgtatgtggaactttctgtttggtagaggatatagaaaagagaaagggatatcgaatttctgacaacctacgtgcttagtgctttgtctaccaatgtgatgaggacatatttattttttccttgtgctttctgcattgagacaagtacattataagcttatcatacaaatgattcaaaaaaaatactcgccatttattttctattagttctttttctcccgaggttactgccctacaaggagctattttaacctcctcctgtctttgccagtgagaacatcttgacatgactccaattccaattctgatgtactggaagaataaaaacacatttatttaaaaaatctaaagcatattaatgatgccatagaaagacatcttgcttaagataaacccattaattttacctttgtaaacatgtttcagcatgactgtgtgattaaggcttcattctgtgcagactacaactgtagtaacggcagcagccaagaaaaaatagcaaaatatttttaaaaacagaagcaaacagcaaggctttcacaatccattgtttaaattcatcttttatatcttgttttattacgtttttctctcttactttatgtgtataatgaaataccattatcactgtcatcatccccagattaaagcttcgagaaagaaagaaagcctatcctagaattgatttttaggccattttacttgagatgatcgacaataagaggattttcatttgctttgtcagtgtaagctggctgctgtgcatctgcagtgaaggcagcacaggtctctgtttgcattctgcggtttgttagcagcaatgacctgtcacagaaaggctctacagcacaatatttacacagatcattagcagagcaggccctgtttgccagatcgctaatcagttttgtgactgccccagtttcatcaagactataaataaaataagccatcggaaaaagctccaaaatgggcattgtcagagctggtgacacttctggcagctctaggcatataaatcctctgataacaatgcagtggtagtgacaaataaaagactgcatttaaactatgagtctgaaaatgagtgtgtgtgttacttcaagaggaccttcttttctttatactctgtcgatttcagcttactctagccctatggtgtaaacaagctagcaatagtcaagtaggatttgcttttttctcctttcactcacgattgaaatttgtttactgcagtttgcgatgtagagtccatgacatgtgaacccatggtgaaaagccacaaaagaaggggaattcgtaagtgagagggcacgctggacttactggcctgtctgacctccgttgaaaatattactcacagaatcagtagcattcaaaatgctgacagaaagattgtaagaggtcagcaaagggtgaacctgtataagagcctagggaccaacctttaagagttatgataaactattagctgtatggtggccacaattgaaatgcaactatttatttatttctcttttttcattttttgatatgtgcccaaatcaatagtgattgctttctcctttgttgtagaaaaaaagtatataaaagactcagaagagtcaagccctgggatgttttaataagaagttgacattgaataaaaacattatttgcaaagagagtttattaaagtctttcagctttgctccctctgtctcctttgtcacttgactcttactgagaaccacaaggccatctagtagagattacatggtaatcattagtagacagatgcaattttgtctgccatgtaatctttactttctgttccaggaaaatatgagtatttttaaagttagtggaaatttacagattttctatatacagggcattggcaggccagagaaacgctaattaattcatgtcataaatgtttattgtgcagctactatgtgtactggatagaaagtagtatctgacagacatgttccttgccctctgaaactcagtttagaaaagagaatacaggttcaaatataatgaacatttgttttattttatattacataatatctttttttgttgttgtttctatcttcattttcaccaggggaagggaatctgtgtctattggaactcttttcctatatttgttttaggattgccatacctctggtttcccaggtatagttcatcaaaactagggacagatctagtctttatgggaactgcaacttataaaatgtggagttcctctttaggaaaaaggatatgcagccctagaaaatgaaaggatccaaatttttgaagaaaatgaacttagtatggtatattcttactttttttctgagtgaaagatatcttatatatcataccaattcccaataagtttcatccttttgtctgcgttattttcagttttcagtaaaataaatgtgtgtataccacaacctctaagtacttcctttagaccttatggtttgaatttggtatgaaagaggaagcttctaaaagtgttttctatgtgcatgatgatttataggcaaatataccggcacatatagttaccttaaaacttagatatttaagtatatgttggatgaatgaaaaaattgaagaacagaaaaatgtaaaaacaaaagaaggtaagtcaaacattttgagagagttcttggatgaaaagtagaaatttaaaatgtaaggttgtaaaaaatagcaatgtccagtaaatgcatgcacataaacatgaaataacttaaatgtcattatgctaattttacttgcataaactttcaggacatgaatacagataaggacataattacagtagttagaatgattaaaaaatagtatgccccatactatgaatttcacacacagtttgattactgggagacatttagagcagcagactaaatgtataggtgctatactgtaaattgtaagttggatgggaggccatcaactttggtattggctatagcacttcaattaaagaaaagtggctgggcctggtggctcatgcgtataatcccagcactttgggaggctgaggctgaaggattgcttgagcccagcaattcaagaccaccttaggcaacaaagtgagaccctgtctaccaaaaattcaaaaaattagccagacatagtggcacgtgtctgtggtcccagctaaatgggaggctgccttgagaggattacttgagaccagaaggtcaaggctgaaattagctgtgatcatgctactgcactatagcctgggtgacagagtgagatcctatcataaataaataaataaataaaataaaaaataaagaaaagtgtcatttacatctttttacgttttttaaaatcctgtttgaggtattttcttatcactatacaaagtcactaaacatatgcattctataatagggtaatcaagtaaaaaaaagagaaatttattttttcataatatttttgttaaaattcattgaaggatatcttacagaaaatgtgacattcttacattctgattatcagggcacaatttgataaaattttatcaagtgaacaataatctggtaatcagaatgcagattaagaaagagaacactaaaacctcataaccctaccttccctgcactatttactctaaactccattccatccattaaagatagtgatgactgaatttttttttttttttttttggctattcttctgactctagtttctgagatttttttttttattatactttaagtgttagggtacatgtgcacaatgtgcaggttagttacatatgtatatatgtaccatgctggtgtgctgcacccattaacttgtcatttagcattaggtatatctcctaatgctatccctcccccctccccccaccccacaacagtccccagagtgtgatgttccccttcctgtgtccatgtgttctcattgttcagttcccacctatgagtgagaatatgcggtgtttggttttttgttcttgcaatagtttactgagaatgatgatttccaatttcatccatgtccctacaaaggacatgaactcatccttttttatggctgcatagtattccatggtgtctatgtgccaaattttcttaatccagtctatcattgttggacatttgggttggttccaagtctttgctattgtgaatagtgctgcaataaacatacatgtgcatgtgtctgtatagcagcatgatttataatcctttgggtatatacccagtaatgggatggctgggtcaagtggtatttctagttctagatccttgaggaatcgccacactgacttccacaatggttgaactagtttacaggtgatgaccgaattttaacatagactcagtttgcctggttggacattaacgtgtgtgtgtgtgtgtaactcttatttttatatactatgtttttttgagatggagttttgctcttgttgcccaagctggagtgcagtggcacaatcttggctcactgcaacctccgccacctgggttcaagcgattctcctgcctcagcttcccgagtagctggaattacaggtgctcaccatcaattcaggctaattttttgtatttttagtagaaacagggtttcaccatgttagccaggctggtctcgaactcctgacctcaggtgatccacctgcctcagcctcccgaagtggtgggattacaggtgtgagtcaccacgcccagccattttgacataattttaaacttagaaagaagttgcaagaatagtagaagaaagtcctatatacccttttatccagatttttttctaaattacatttgaatatattggtagtgtgctctctctctctctctcctttctatactatttgcaaattggagccatcttattattttaatcctaagtactttattgtatatgtcctaaaaaccagaacattctcttaggtaatcacattttattatataattcctacatagtttaaaaaatcaggaaaatttagactatattttagtgttttttaaaaatatatactaagtatgaattatttcttaatgggttaaacatagacttggaactaaaaaactctaactagggccactctttctttatagaagttattgacattttctcaaggagaacagatgaaatcctagggggcatgccttgcaaattcatcatttaatatgagaactgctactggtagagcaacagctatttggccctatatttcagtgaggccctaaatggcaacaattttagaattaatggcaaatgtagtccctgattctttttgtttgtttttgttaatagactcacttcagcgtccatcaaatattccattaaaggtcgtcttcttggtttcttgatgtagttgctgttggtgatatttcttaatatattaagatggaacaacttaccattccattttgagtcatattttaattcattaagctaaaatgtttgagtaaatacagggtttagcatagtattttgcacagaatactttaagaaatacagatgtttaaaaagcaatcttgctcttaaggaccttcaatgctaatagaaagaccactcctataagaagaatatgtgatgtaatcccaagtgcactaaggattttgatgagggaaaaattatttctccttgggtttatcagagaagatcttgaaagagctggcatctgagatgtgctgtgaagttatgtaggtttctacaggtgataatagaaaaagagtgtatcgaaatgggtatgtgtgtgatgccacaaagaaattttagtagaatttaaggtactgaatagtttgatgagaaggtggtttagcatgagcaagaaaaatgaaatattaccggaacaattttgaaaggctgtaaattactggctaaagagttggatatttctcagaaaatgtagggaaccgtgaacattattttttgaacaggtgatgcatttacatgatacagaattggaaaattccacattctatccttttctattgtctgcccagttcttacctcttaacaacagcttcttggtgtcttaagtattttatgtatatataagagataacaaaatacattattgatttcctttatttggacagcataacacgtatccttttggcacattgctttattcgttagcaatttatcttgaaaaactttccacattaatacatatagaaaattttcagtatttttactattgcagaacatcaaagggatgtgtcatcattaagtcgtactatattaaaaactttgttgttttcagaatcttgttcttatatatttttctgcaatgaatatagtcatatatgtcgttttatatgtaagtagttatttaggataatctgcctagagtataattgattggacatgcacacatgcattttttatttgataaatatgtactaatttatactccaatcatgtggatgcatgaatggtagtacctacttctctatatgtttgctgaagtttgtgttattaaatatgctattctaataagtgaaagaatattgatagagttttatttgtagttttattatggttgaacttgaatacacttttgtatacttaaaagtcatttgcatttacttaattttttatttttattttatttatttatttttttgagatggagtctcactctgttgcccaggctggagtgcagtggcacaatcttggctcacttcaagctccaccttctgggttcacgccattctgggctcactgcaagctccacctcccgggttcacgccattctcctgcctcagcctcccgagtagctgggactacaggcacccgccacaaaacccggttaattttttttagtagagacggggtttcaccgctttagccaggatggtctcgatctcctgacctcgtgatcaaaccgcctcagcctcccaaagtgctgggattacaggtgtgagccaccgcgacggcctgcatttactttctatcaattgtttatatacttgcctatatttcttttgagtttgagtcttttgctcataaatttctagaaacacttcatatagtaaagaaattatactatatgaagagtaaatattattctttacttgattacttgtagtttcaatttgtttacaatatttcacttgatcttagccaaaagactgagaagtgaatgtttacaatattttttcatgaagttattgttactgtattcacatatacccattttttaatcttttagcttctagacttttagttataattacttataccttaaccacttaaaggttataaaggaaatgtcctatgtttacttctagagcctttgtggttttattttctacatttaatgctttaatctctttaaaaataatcttacacgcagtaggggcatatgaatctacccatgttatttttccacaaagtggtaactcatatttctttactggtttgagcattaatatacactttttgggatattctattcttttttattcaccaatctagactctattaaaattctcacagtcctgctttaaaaaaaaaaacttattttttcttttatgctgtcctctatcagtcacatttatttacatctttggcccttctggttttaatttgaaaacagcctgtactttctcatccctagtaggcagaaaagaatagctgttcaccatttcaagcctctttgtttgaaaaatgcattcagtgccagtgagatttacatacatttttagtaataaaaaagtaaaagttttttccttaacggcacaaatcaacctgagttactgtaaactactttatgaaatacttttataaagtattagtacttgcttacagcttataccctgcaaataaagcccacctaaacaatgaagagattgtatattatatatttgaagtagataggtagaaaagttttcagctctgcttgatttatggttcagagatctcagcaaggaagcacattctttctgcctctccaccctgcagttcacctattagcttcatcctacttctgcttccccttgtagtatgcaatggctggtaagagcaatgagcagtacaggatttctcattcaaatccagtgaatacaagggaaagagttttccccttttatgaatagaagtctttccttctttatattataatagaaactatttgcactgtctgcttattcccagataacaatttacaaacacaggtactgactgatgtatgtctgattttttgaaacaaccaggagcaatgggaaaataattacccacattgtctaagagtaactgaggcccaactctggaactggggagttctgtttattttattcagatatcccttctatggataaagctgatctttccctaaacacagggacgatttacagatagaatggatatctgaataaaatatggattctgttaaaaaaaagaaagataaggaaaatgtaagagggttaggcagccaactgtgtgcactagaaattgttttcttgagaattccatcaggggcattctctgcattctctactttatatttgtggttaatccactattctgtctctcaaagaatgtatctatgtgtgaactggttttgttactctaatttctgtgtgtccagaatggcagctaattacttggtaactttctctaacctaagattttgaatagctcataagacatatttcttttaattgcggaaatgagaagctaatgacttgattatgatgtaaaagtgagttactgtgttcacccgcattttatgttatagtctatattatgacacatatatcttaagatatatttgctcaatccaaagctatgaataaaacggtaaatacttttactacaggagaaatacttaaagtaatatattttttttggatgaaaagttacttcattagctccaaagtgaattttatatttttagtacacttaaattcaggtttgcatataaattgagtctgtgatatcatctcagaattcactaggagtaagagttcttctttaacacagcctttgtgaagctttgtctcttactcttcctcattacttcccacttgttcttttgaagctgctctattctacagacttttgaggcatttaggggctgaatgattgaatttatttgctctcgtgagataaaattcaagagttttttgtttttttttgtttttggaaaacataaatccttcttcgttgagaaaaaaaggatgggaagcagatctgctatctaggctcttcctttatatagaggacaaggaaataaaagtcatatccctgttgttatgaaataaatcaagttcccctataacctatatgttgagtctctaacccgcaaagtgactgcatttggagatatggcctttaaagaggtaattaaggttaattaaggtcatatgaatgggaccctagtccaataggactggtgtccttttaagaagaggaaaagacaccagtgaagtgcttgcatcaagaaaaggcaatgtgagaacacagtaaggaggcagccatgtgcaagcaaaggagagaggtcgcaggaggaaccaaacctgttgacaccttgatcttagacttctagcctccagaactgtgagaaaataaattcccactcttaagccacctggttgatgatactttgttataatagccctagcagactaatacatttgtaaacatgctaaaagcagactttttgcaaacaagctagttacgttagctagtgggagggtttttatctgcaaggtgtttttagcagcatgtacttggttgtttagcatctcctgtgttaaaaaaaaaaaaaaagcaaccctagaatctatggatatatggggcatcgcttcctggaaaatattatgcatcctttgtgcctatttgattataaaatggaagtgtttattactgatactttttatcttttgtgtaagtaatgtgccagaacttatttatcgtagtaggaagagatccagtgaatactcaacctctcaccttagttctccctgagcctctagacactagacttttatatcctaaaaatgattaaacatttctatttcatatgagtctaatttgacagttgaattatttgtaccatctcaccgatgataaaattagcagttatattgtgtagaatatacagataggtaggttataatttttctatgttaagtttatatagagaagaacaaatgccacttgtaactggtgatgaagcatagaacaatgacttttctacatatctaattcaataaaagagtttacatgtggaaattcaacaaagtaactatactctggcaatgcacatcaacttaactggtgggaatatttcctgaggtggaaatacttcagttttatggtataatctaccaaggatgagtatagtataatccaccaactaagataaattgtctccagttttattaatcaaatgaatattatattggaagtgagcatttaatatttatatagttgtctacttcaagagtttctgattatatacatcagaaaaataaaatttttgataataaaatatattcaaaggatcctcccaaacatcccacagtaacacagcacatgatctaacaaccctaatagtcacaacagtccacataatgtctcattgtatatgcttccggttttaatttgaaaacagcctgtactttctcatccctagtaggcagaaaagaatagctgttcaccatttcaagcctctttatttgtttgaaaaatgcattcagtgccagtgagatttacatacatttttagtaataaaaaagtaaaagttttttccttaacggcacaaatcaacctcagttactgtaaactactttatgaaatacttttataaagtattagtacttgcttttaaaagttatgctgttcaaagagattttgaaaataccttaatgaaacacacaaagtgattacctgtaggttaaaagaaccatcctagatggaagaaacaatgtaatgtatgtatttattgttaaggatttctatcttgcccatatctctatcttaaccaccctagctgtattagtctgttttcacgctgctgataaaaatatacccaagactaggcaatttacaaaagaagaaggtttaatggacttacagttccaggtggctggggatgcctcacaattgtgttggaagtttaaaggcaaatctcacatggcagcaaataagagaagagagcttgttcagggaaagtctcctttataaaaccatcaggtctcatgagacttattcactgtcaccagagcagcatgggaaagacctgcccccatgattcagtacctctcactgggtccctcaaacaacacatggcaattcaagatgagatttgggtggggacacagccaaaccttatcatttcaccctggcccctcccacatcttatgtccacacacttcaaaaccaatcacgccttttaaacagtcctccaaagtgttaactcatttcagcattaactcaaaagttcacagtccaaagttttatcagagacaaggcaagtcccttccacctatgagtcagtaaaataagaagaaaattagttacttcctacatacaatgggggtacgggcattgggtaagtacagctgttgcaaatggaaaaaacaatggctaaaacaaaggccccatgaaattctgaaatccagcagggcagtcaaatattaaaggtccaaaatgatctcttttgaccccatgtctcatatttgggtcacactgatccaagaggaggttcccatggtcttgaacagctctgcacctctgtctttgcaggacacagcctccctcccagccactttcatgggctggcattgagtgtctgcagctttttcaggtgcacagtgcaagctgtcggtacagctaccattctggggtctgaaggatgatggcattcttttcacatctccactaggcagtgccccagtggggactctgtgtgggggtgcccaccccacatttccatttcacaatatcctagcaggggttctccatgagcaccctgcccctgcagcaaacttctgcttgaacatccaggtgcttccatacgttctctgaaatctaggcagaggttgccaaatcaattcgtgacttctgtgtaccctcaggctcaacatgtaaaacctgccaaggcttggggctagcacccttggaagccacggcctgagctgtaccttggccccttttagtcatggctagagcagctgggatgcagggcaccaggtccctagactgcacatagagggaacctgagcctgcctcatgaaaccattttttcctctaaaacctcccagcctgtgaggagaaggactgccacaaaggtctctgacatgccctgtacacattttccccattgtcttggtgactaactttcagctccttgctacttatgcaaatttctgcagccagcttgaatttctcctcagaaaatgggattttcttttctatcacattgtcaggctgcaaattttctagacttttatgatctgttttccttttaaaactgaatgcttttaacaccacacaagtcacatctttttttttttggaagtctcactctgtcacccaggctggagtgcagtggggtatgatctcagctcactgcaacctccccctcctgggttcaagcaattctcctgtctcggcctcccgagtagctgagactacaggcgcacactaccatgtccggctaaaaagtcacctcttgaatgctttgctgcttagacatttcttttgccagataccgtaaatcatctctctcaagttcaaagttccacaaatctctagggcaggggcaaaatgccacaagtctctttgctaaaacataacaagagtcacctttgttccagtttccaacaagttcctcatgtccatctgagaccacctcagactggattgcattgtccatatcactatcagcattttggtcaagccgtagaacaagtctctagggagttccagactttcccacatttttctgttgttttctgagccctccagactgttccaacctctgcctgttatccagttccaaagttgcttccacattttcagttatctttagagcagagtcccaccccactcctggtaccaatttactgtattagtctgtttttatactgctgataaagacatacccaagactgggcaatttacaaaagaaagaggtttaatgatcttacagttccatgtggctggggaggcctcataatcattgcagaaggtgagaggcatgtctcacatggcagcagacaagagaagagagcttgtgcagggaaacttccctttataaaattatcagatcacatgaaatttactatcatgagaacagcatgggaaagacctgctcccatgatttaattacctcccaccaggtccctctgacaacacatgggaattcatggtgagatttgggtggggacacatcactagataacagcaaagctgtacaattcttaaacattgtcatggaaaagtaattccacaactctactttgaactatatgtgatgttgtttacattcatcataccctctttatgctaaactaaaatatttagctgtaatttatgataactatttatagttcctctttctttccctctctgaacttcctgcaataccctgcaaagttggtatattatctacctttttcctttacttttactatttttgtgaacaaaaatgtcagaagatgaagtattttaagtcaatttttttttaaatggtgaaaaattttaaacactgtgaggggccaataaaagagattattttcattgtgagggacattttagcatgagtcaaatcacatgacagtcaattttgttctttgattaatgtacaggtacaatgaatttcagttatgggagaacttctctttctcctttgacttattctctcaatttttgcactctcatttttgtttttttgttgttgttttttttttttttttgtaaagagtttctagtaaggactatgtgttaatcagttttaagaacacagattttatcaaagaaaattatctctgtaaaatatttgcactaatggaaaaatatgtgaaccacccagtcttattttattggaccccaagttagtttgtgtttgtgtgtatgtgtgggtatttatctgatatcaaccattatcttttaacatcagcatgaaacaacatgctggtctgaaacataaaaatatatatcactcttaccaaagccagtctgtattttaattgctttttcctgaaagtggaatcatgtaaaacttaaaaacagattgaaatgaaagggaaaaatttgattctgtaattaacttaccatgtgaccttcaccacactgatggtccttacagatctaaatttctatatctgtaaaataaagaaggttgattttacatgatttcaaaaaatatatcatttttttgacagtcatagaagttttatataattctctattctagtctactgcaaaggaatagcagcaggtgaaaactataatgtttgaccctgaagattattatgtgatatgtgtaagggtcttaatgtgtacaattccatttttaggggctcaagagataaaatttcttttccaaaatggataaatacaaaatcatttttgcaataaaaatgtattgtgagggaatcttttgaatcaatgtgattacttgttgtggaagatacaggccatatggcatagcgtcttgcctcaaggatcttatcacttagtgagtgaaataaaacaattacacagataactgccagtaggcagcactaaatgtcttaagtgatggatagacagagaggtaagaagggtccaatcaaatgctgaaatgttaataaaacccagatcacaggcggtgatgatcaaatgaattgaacaggcttaggagaaatccgtgaaagaaagaaatctgtatccctgggatctttccatttttgagaatatattacatttgaatctcttagggatgtgtgattccccttccctttaaaatagttacagtataatttcattaaaatcttggattttgtcagtcatagcagacaatagcattttatgtcctgtgaagaattgtatgcataattttggaaacaagacaaaggaaagaggctctctaagctgttagaaacaaaggatttttaaaatctttcttctctcatacctccattaaggttgtcttttctcctttaaagctataagaaatattctgaatactaatgtgacagaaccagatgcaatccccaaatatcatatttacttaatataaattcatagtccttacctttaaggagatttgacaattcactttgtcttttagccttggggtagtcaggaaagttaggcacaatgttttaatgctcattccttctcttttgctcttagctatcattaatccctaatgcctggaactgcataaatttcttctacaaaggaagcccacaggtcgtttttatttggagcactttttttaatatgcgccacaatatattccggtatgtattacctcgtctgaatgcaaaactgttttatatgcagatttaaggtagtgagcagtcaagtttaaaaaatggttctggtatcctgtagcttctcaataataatatactcttacattccaacagagaaggatggattatgggtttttcaatttgcatcaggcatattaattgcagagtagggcttccacataaaatatcaatgtactggaacaaactgttaatgtaccagaatatgaacacttacattcatttctggagctttaaaaggaatcatccccctcccccgctttttaatatctatacctctggagatggtacagttttttagtcagttaatgagaactatgtaaccaccatttctccaaaaatccctaattagattaagtgcaatagggctattttagtcatttctgctggggaagaatacaacaagccattagggaaagagaataatttagaaggtttgaaagaaacttattttagagttacttttaagaaacatgacatggaagatcaactttatgtcctagttggaggcagggaggcatactcaacttttatttgcattatattctcaactatgaagagaatacctaaactagtaaaagtttaattgaaagttttataagtaattttcagctgacgtttagcactgtaggtttgattgtagagaactggtactttatttcatgggagtacttgaattatatattctcttgtaagcataaaattgtgaatgtccatattttaaaaaagcattataataataaaaactcttgtgttttaatttgtctaatacatttggtaactaatataaattatagatactctggttagactagaatatagatgaaaatatttttaaatatgttctcttttttctttaatgtgaatatttcttatttttcaaaaaataaagcaaggggaagaaataaagttgagatttaaacacggctacatttttttccctgaggcttgtacttaatatgcaaatgctaagtatttggtaaatattcattaagtaaatatcagacctttcacatttatatttcacttttcatttttgatacatgataaaatttgtgattttattattttctaacaaaaatagaatgggggcccacttttcaaatccattctgcaaaagacaatgtttgagtttttataccacagctgtcctaagtaacgaattatctcaccagagaagagaagaaatgctaaccacataatccaacaggagacttgattcattttgtgtctggaacagtcagtgcaatgttacaaactgaaatgagtttccttttcaatcttcaggtgaaaaaagtagtgagaatgtcccgctttaaaaaaaagaaaatcaatgtgaccttttttttttttttcatcttccttgagaaataatgtgtgtttgtgtgggggtgtgtgttttattttgcagtgttagttttgacctcattatgctcattatgctgttgtaaggctaagtatgtcatgggtcaaaatgaaggcaaaatagacctttctcagcattaaagcacaacctaatttatggtaaaagtaatttccatactgttttaaagaaatagccctggacaacatgaatcttcctttgctgtagcatgctggctgaaaaacgggttagatatgcattccatgaaaagaacagggaaaatcactagaactgtaaactctgcatttgctgggtgctaacattttgagaaatgctgaaagtgtgttattttggttttgtattacatttagtaggtgtattttaaactcaaagaatttgatttccagtaagaagcccaaatcaagtgttgcaattgttttatttaaggtcaattctttcaactaaacaccttttatttccagatgtgttttccctcttgtttgaaatgccacatgacacaaaatgctgcctgttttgtgtgcttttttctactgcatgcatagatagaaaataggttcaagtgtttcatttgaaaatcttttacttaattccaccaattgaaacgatgacatcatgttttcagagtttacctttcttggtaaacatcaccaacaaaaggttaatgtttatgaaggacatcttaaatcttaatttgatgcatacaataatttaaatttttataaacttttactaaattaaataaaagctgctttgaggttgtaagtgataatgctagaggtaatgattaaaggcacctgcccctcctcctgatgcatctaccttctgtatcctctgataaaaatcaaatgaaaattaatctcaggttcaaagtggtgttaactgtattcaggagtcttaggatgtcctttacttcctttgaagcattacctcatgacctaactacaatttcagcatagctgttgatttttgattgtaggttttattttgttttttttatttttacattcttgtggggagggggatttaatctcttaaactttgttggcaaattacattgatgaatgtgttctgacaggaagctttactgaaatgaaaaggagttgtgtgtaagggtgggaataactattctaagagctttttcatggttctcgttgccagggaaaccactgctttgtctgtacatgtttggaatggctgcctcattagaactcaggctcctagacagtcacttgtaatactggtaaagtgaaaggaatgaacctattttagttgattaacttcaaattaataaaaatagcatatttaaaagatagaggtttaaaagctaaacatatagaattatgggggaacaatgaagttaatattgattaggcctattcagccacttgtgtgagtggaagaataattttattttttactttctctttgcctttttacatatttatggggagtaagcaaatggactattatatgttaatgccaccaaataaacttgggatatgatagatcctgattttttcacaaatatacagatttttttcttatgaattcattttttttccttgccatgactggcctgtgtcatggctaaaatattatcaaaacagactggatttactggctctcaggggcacaaaaggtagtgaaaacctagattgcaaatccatctctgggtagtttcatttttcttgaaagaacaaaagaagcagcacactaagaaattatatgaatcaatattaaaaacagaggataatataacagattattgctctaaatttaaattatttttaaaaagacaagaaacgggcatagacagaaacatctcaagttcaaggagctgagactaactctcaatatactactacttcttccttttttttactataagccaaatttcctttggaaatttattgacatttaaaatgtttgtttttaactcatgacaaagagatgaaatctttttataagtttttttcttccaacaacagaagttctttaaatttcttgttctatcattctatctaaatatactcaaagtactataatcttaaatattattatttaatactctttcctaaaggaacaaagaaaaacaaaatccaaagatctttttaaaaagtctatattattcaaataagttcgcttcaaaaaattggcaatactgattttttatttgtagtactattttaggaaaaaatgtcaaaatgatattttggactttgcaagtcctgttttgggtagaaatgtcaaaaacttaattttatgtatgttaaaacttgaaatggccattagacattcaaaagaagatgtttaaaaggaatattttataaatgtaggattcatgggatgtggattttatttgagtgtggaataagagaaaggtgaggataaagtctgggtttaacatgactcccagtcctggatgagcaattgtgtggaaaacagtgccattcattgagatgaaactactaaagcaatggttttcaaccttgcctacacataagcatcacctgcggaactttaaaaaaatacgaattcctgaaatccaacctcagagattcttattcagttgaaatgggtttgggtctacaatagtatttaaaaattgctctcctggtgattctaatatgaaaccacctttgaataccctgatactaaaattcattcttgtgcttcctaactttcagattgcctgaaccttttaggggcacctgaaatatttttaaaatctcaatgtctaggtaccccagatcaattacatcaacatttctgaaagtcagactcagaattttatttttattttatgagacagagtctctttcttcctctgttgcccaggctggagtgctgtggcacaatcttggcccactgcaacctctgcctcctggattcaagtgattctcctgcctcagccttcctagtggctgggattacaggcgtgcaccaccatgccaggcttaattttgtatttttagtagagatggggtttcaccacgctggccaggctggtctcaaactcttgacctcaggtgatcctgtcgtctcggcctcccaaaggtactgctgggattacaggcctgaaccactgcacccagcccagtctcagaattttaaatttcctcaagtgattctcatgagtgtcagggctggggaatcatgatactaaagaaagaatagttcaggtggagaagctgctgtttgacagaaacgtggtatttgaggtggatctggaacaccattctggaaggacttagtaggttcttttttttttttttttttttgagacggagtctcgctctttcgcccaggctggactgcagtggcgctatcttggctcactgcaagctccgcctcccgggttcacgccattctcctgcctcagcctcccaagtagctgggactactggcgcccgctaccacgcccggctaattttttttttttttttttttttgtatttttagtagagacggggtttcaccgtgttagccaggatggtcttgacctcctgacctcgtgatccacccgcctcagcctcccaaagtgctgggattacaggcgtgagccaccgcgcccagccattagtaggttcttaaatgtgaatctgatgttatacagcaaaagtctgtacgggctacagaaacataatgtgtaataatggaaccctgcaagaggagggagtcatgagggtgcttacaaagaaggacgaaaaaggagcaaagagcagaaggttgggaaacagtggcctttgagaggaaggaaggataaaaagaaccagaactgaaaactgagaaaaatatagaaatggatttggaaagaatgatgtcatagaaagcaaggcttttaaagaaaagttgagactcagtatgaaaaaataatacaaaaactaaaaataattaactggacttggaaatcaagggagatattagtgcccttcaaaagaactgttttaggggagaagtagaagtagaaagtatttggagtacatgagagaggaatgagaaaccattgtctgagttagtagaacagtggtttcaaaatacggctgcgtataagaatcacatgggaagggccaggcacggtggctcacgcctgtaatcccagcaatttgggaggccgaggcgggcggatcaagaggtcaggagattgcgaccgtcctggctaacacggtgaaacccgtctctactaaaaaatacaaaaaattagccgggcatagtggcgggcgcctgtagtcccacctactcagaaggctgaggcaggagaacggcgtgaacccgggaggtggagcttgcagtgagccgagatcgcgccactgcactccagcctgggcgacagagcgagactccgtctcaaaaaaaaaaaaaaaaaaaaaaagaatcccatcccatgggaagtttaaaaacaaacaaacaaaaaacaaaagagaaaaccacaacaacaacaaaattatgcctgtcactgtaccctagaccaacggaatcagaatttcttgaggagggaaaaggacatcagtgtggctcaaaacctccccaaggtgactctaatgtgaagccagatttgaaaaacatttcatagaatattcttttcagaaacttgactgaaaatgaaaggcgaggatttagggtagtttctactcggaggtggaaattgtgagagaaaaataagagacttgactgtaagaactatgacagagccaccgtgtctgaacattagttgaaaatacttgagatcagaattcaggttatggtagaaatgaaagtatagaaatcaaagtcactggtggaaaaatcccctctaaaaagggaatggtgaaaagctcatcctgtgggcctatagaaaaagatgtgaaaatgagtaaaattctaattcggctgcttttctttttatttgttatataaagagatacagacaggacattgaaggaatcttactaataaccacaatttcccatatgattatattcaccctttgcatttgtagcggtggaaatatgagggacttgaggtgctttgtatccatttggaataacttatgtgggaaatggaaaaggtgactgataaagatcatgtttaactagttcatatagaccagatgaggtttagagtgtcataatctacacaaatacgtggtttcctctaatgtcattctgatatcaagatacagaaagagaaaaaaaattggtacagtgatccagtacttgtgatcatcatggaaggtagaacataaatgaagagatttaaacactaagaatgtgggcatgaaatttctgttttaaatggtccatcatttgtttagatgaaagaaaaactatggggggtgcttataaactgagataaaaagggaagaatctgaatctttcaattgtacaaaaaacagatagatacagaagtacaatcttcttttagtatttgtgaagtattggtttcaagacccctcagatatcgaaatctgcagatgctctagtccctgattaaaaatggtatagtatttacataaaactcacacacatccttctatataatttaaataaactctagattacttatcatgcctaatacaatgtaaatgctctgtaaatagttgttatgctgtatttttgtattatttttattgttgtattgctatttttattgttttttctcaaatattttcaatctgtgtccctttgagtccatggatatagaatccacagataggaaagacccagtgtagcaaagaggtgagcaggtaaaataataaattaattttactaacagtcttttagatattgaagctctaaatttgaaatagtttgggataaagaatactccaagaatgtctaggaacaccataatccaagataatcattctaggatgtaaagtatgagagaaaattaatacatttaaaccgaagaatttagaatttatattactgtacacttataaacctagatactattcatgataaaagcataattcactgtgaaaagaaatagtaaatgatcaatgagtggggcagtgggggaaggagagagagaggagataggaggcaggggaatgtgaataatctgggttcttgatgtttcagcttctgatagcaccacagcttcctgcaatggattatatactgcccctagaaagatcaaaaatcactgggagaagccatctttggttagatctatctttttaagtttagaaatatccataaaatactgtttttctcatggaataacagtaactcaaagcaactctgaatttctaattcaaaactactctaggtttccagcaataagaaaaggtgtttttttgtttttttccccgtcccacgtatgtatgagtttcactgctgggagattacagggcttgattaagtaggagattttgataatatatcttaaggtattagagtgatatgaatttcactagaaatattgatagttttgttttattttattttattttttgagaatgagtctctgtctgttacccaggctggagtgcaatggtgcagtctcggctcactgcaacctctgcctcctgggttcaagcaattctcctgcctcagcctcccgagtagctgggactacaggtgcacaccaccatgtctgccttatttttgtatttttactagagacggggtttcaccatgttagctaggctggtctcgaactcctaacctcaggtaatccacctgcctcggcttcccaaagtgttgggattacaggtgtgaggcacaatgcccgaacgatagttttataaaacctggatttaaggcagaatttagaaacagaaactctaataggaaaacctttttctatattattattattatttttaatgtaaaagtaaactttagtgtcgaaaatgcaaacttggggagggcagaaagatcacacataaggctgccacctcacacctggagggttgcatcgtggttgggcagaggcactcctcacttcccaggggctgcgtatgaatcacaatgtaggggataaagcggttagataaaaatcttgaaagtaaaagtggataagagaaaaatgcaaaggagtttagagtgatgtgtgaaagaattcaataatagattatcttttacaaacaagaatgaagataaaaatatggtttcaaaataccataaacaacgtacggatttgtgtaacaggttattgtatatgatagttgaaagaaaataatgatttgagatgggaggaaatcatttttattaagacataataactttgaatttaatggctgaacatttatgtggcttttaaagagtcagtgcatttccaaagtggtactgcaatatatggaaaatgccagtactggagatgttgcatgccatccatgcagaagtggacattcaaatcttaagaatggatgagatctctcaaaaggcaattataaatgatgacagtaagagaactgaagaacgttgaaccatggtattaagggcacatgtagcatggcgtgacgagagaacatagtcttagaaatcagactgaattgtgtttgtattgtggcttcaggatttactatcttatcttgggctttcctattaaatggacaatttcattgtattcttattataaattagaaataataactttctaacaggattgtggaagtgtgtgtgtgtgtttatgtgtacacacagagagaatataaataattattaaataaacatttctattttatggtagatcgtaaatagaaactaagtcaaaagttaagtcaaagtagtcaagaagattataaggtataaggaaaattcagtattttagaaaccgagagagggttttaatgacaatggttggtcagcagtttcaaaaaccattaagaaaaattgctcctagaagataagagaatgagtctatcccttacaataagcctaggatcacatttcttaacttattcctctcaaaattgaaacataaagtacttctatgcatattgtcttatttgccttatgtaaaagaaaaaaggaagcaaatggtttccaaatgtttaaaaacatatattgtctctctccccattcttccctctcccctctctcatctctcttttctccccttttcctctcctcccactgtatttctccacattttctagacctatcagttttacaatagagaagttgcatttgaagatgtattagaatcttcccaaatgggattggtcgtgagaaaaactaatatatgggatccctaatgctgaaccaattaaatttgtggttttggcatagcaagatttattgactgatcaatgccatgtgtatggtggatatgcttgccttgtctcacagaaaggcaaacaagcagcccattatattaaagcatgtggattacgttttagtccctatggaaaaataatataacttccttattcttactccaatctttaaggatctcaagagaaaaataattgcataattcatcgtcttttgtgatttgagacatacatgatcatgttattggcagaaaatgaattggttttatacattttattgataagtgttcccaaacgtttgtaattagttggccatattcttgtttctctatcttcagaagaactggttattatgattactttttatgaaggtggtaattacaaaatagaattgagctgaatgaaattaaagagaaactgaaaaaagaaattccctgccaggaaataatttcatttgaacgagtacaaatttctttgcaattcttacttagctgaagtgtatttctagttgtgtttccagatttatatcattatgaaaatagccacttcctaggttctcatttttcatatacaaacaatgttcactagcagtaaatttcttccctggattcaatttctgaatattcacaaggtgaaaattgtgttcacctcttttcagatggagattctctgaactgtaattgggtgactatttcatagatgaaatctcagcacgtatcactttaaaatgatatagtgtaaaagggcccaaattgtgtgtgtacacctggatgtgtgtgtgtcagcatgacgtggaaactatgtggatagataaatatctaaaataataggtatgtagatagcatgatgttccaataattaccaataagatcatgtcttcagtggagagtaatacataccaaatttttaaatctttaatttttttcatatctgattatttctactatgatctcttttttatcagaggagttactaaaactacgagtagataagaatacatttgaatttttatgtgtatgataactttaaaattttgcctactttatagatttctcagttggacttacattaaatctctatttttgtttttaacttggaataaattctctaagacactaattactaaattgtcagtatttataatgtaaacattttaaatcccctaaatgtctactacagaaagaataaatggtgatgtgtctgtgttatggaataccctgaaaaccatggaaaataataataaagctctacgtacattgacatggaaggaataaattaataaattgtttcactgaatgaaaatcatccaagttgtgtaaataaaaatatgtacctgtagggctgcaacattatgcaactcaagcaagtatataattcagcagtgctattaggtatgcattatagatatttctgcatacaaatatacagtgaagagaaataattcatattttaaaaatgtatatatgtttatacatatgtagaaaaagttatgaaagtaaatactgcaaattactaacagtggaaactcttttaacaggtaggtgtgaggttaattttgctttttattttgtgttacacactttcgtattgactgaattttaaaattagatttgcattacctttttttcctaaaaatataactataattgaaaacctagtttctgaattgtacattctgtttaactcatgttctttctctttaatcatcagtttcttcactgacatcacaaaaatactaggaattttccaattgaaacaaaaaacctaaaaatcaggaaaataaagaagtattttagaaccaaaccttctcttagtgtcatcactctttattccaggcctcgaaatgaaatggcacagactgtttttgtctcctctcccgaagatgcttggtttattcagtaatcacctcccaactttgcaatggcccagaaagatagcctttactttgcataccttctaaaatactagcctgattcaagtatttatcattcttgaattatagctagtaacttcttcactggtttccttgcctgtaatttcttacctttgcagtcatccccagatattgccatagggctatcttcctaatgcagagatcaaatcatgttgttatacttaaaatatttttggctctatcatccacagagtaagtttcagatttccagacatagcatcatgacctttcatgtcctattgccagattgctcttttagcatcacttcaaacttcactgtttttttttaatatatatataacttttaagttaagggataaaggtgcagatttgttacataggtacacttgtgtcatggggatgtgttgtacagattatttcatcacccaggtgttaagcctaatactcattaattatttttcctgatcctctccctcctcccaacttctgcactccagaaggccccggtttgtgtgttgttcccatctacatgtccatgtgttcttatcaatacctcccacttaatagtgagaactccaagtgtccataaatataatataccattttatgcctttaagtcttgttgtttacatctcttattcttctagtctttcaaggcccaccacaaatatcatgcttatatctgacaatggaaagaaatattcctgctctcctagggcactttgctttacctatattacaaatcttatttcatttatacttactttagttagctttcatttgtttcactcagcacaaaataatgtagtcttgaaatcaggacccactttcgattgatctctgacctagagtccttatctgaattcaatatatttgtttgccttgcttttaaccaaatatatttggaatccgtttatccatacacttatgaggaaacagtattgaaaaggttgctatccattaatatggctgtggaaaaaaaatgtcaccttagttctattttaagataggaaaaagtcttatctatttttagtagatttgataatactcgtatgagtttaaatcttactgatgctgtacagttgtgctatccaatatggtagccaatagacgcatgaggttatttacatttgtatttaaattaatcaaaataaaataaaagttccataaatataccattgtatgcctttaattcttgttccaaggtttcagtatattatagaaatttttattgtcacagaattttccatttaaaacctctgctctaaagtttaaactcaaaatataaattactcctgtgctaacttggtaaaatcctgatacagaaatggcacagtttacagtagattttttgcattgttttgatctaagttgaatatagtcaccaggcaattgttacagggagtcatcatttcttttttttctttttttttgagacggggtctcgttctgttgccaggctgcagtgccgtggcgatcttgactcactgcaacctccgacactcccagattcaagcgattctcctgcctcagcctccggagtagctgggattacaggcacctgccaccacgcctggctaattttttttgtatttttagtagagacagggtttcaccatgttggccaggatggtctcgatctcctgacctcctgatccgcccgcctcagcctcccgaactgctggtattacaggcgtgagccaccacgcccagcctcatcatttctttaacactttaaaacttattctaatgaactcagttgattgcatatacccctttacccatccaggtcatatgaatcactgtagtagaatcagctactctgggggaaaagaggagaagaggttgtgcatgtttgtggagtatgtattattaaacaaaagtcccagttccctgtggtagcagatctgaccattctgaccatcctgtggctcaattttaggaaataatgtctaagaaggaatcaagaatgaatggatgtactgcactcaaaatataaatttgttctcatcactagtgtggatgtgttccatccttactcagtaattgtatacagtgtcatgccttcaaaccttacataatcgtctgtacttcattcattctcatccttcaaggttcaccttaaacttttttttttcctaggttttctccacactagctaggaagtttgcatgtacagaacgtaatgaaaaaatgaaatttctctatgcaggaattcgacattgtgtgttgaatcctgtgataacagcatttcctatgcagactcaatatatatttgatcatctaacatgaaaattgaaactggcatctgtttgtaaaccaccactttgctggctcaattttagacctgcaaaggaatttgctgcccttttgttaactagataagctatatatttcactttgaaaagacatgtccctgcaactttgatggtgagatactgcctcataacattcatttttctctattaaggtattatagttttgatttaataattttcagcaaagattcatttaacactagagtgaatgaaaatctaaaagaggatcaaatggttattagtggaaacagaataacatttaccagttgaccttctgtaatggagagactcctcagtgggaagaaatctttcatgttgaaactttcctgatagagaactctttgcatatataatcaataaggtatgggcatagcttcatctttggtatgaataacaaaaaagttgtcatagaaagctgtagaattaaaatttatttttcagaaggagtattgtttgcttctttcaaaagtggaggtaaaaatgatacaggggaaggtaccctcaaataaattagtataaccaagtaatagtttttcagaaatagattagaaaatattcatcccccaaaattaatgtttgctagttacatttatcaatttcctttctacaatgctaattttaacatcacaatgctttcattagtgcattatataaaatatcaggtatatgtagattggtgttgttgaaataaggttttgttgtttaaaaataagatatccattcaatatacatgtattaacactaaccacagcaaaaaatcaaaaagaaaaattaagagcacttttttcgctactccccttgaacacacttatctcttatgccttaaattagattgtatataacaattctaatatattggtatctatataattatataacttaattttaatcagggaagcaaatgaatattcctcatcattttaaacctttttattgttataccatttcctttttccctgtttttatgcttttgcatgtttaacataatatgaaacctcaaaagatatctctgggcaacttctgaagattgctatgttagcattgctaaacaaatgtattcaaatgcattttcatgactgaatattatgcaagttcagtgttaaccttttccttgcttctttgaaaattgttttaggatgtttctgaaaataacatcatccagattaaaatgatgaaaataccccaaaacatataaggctcataaagagtgtgggatataagcgtgccagctaatctagttctcattctcataaagggcaatagtggcacttaagagccagtatacctattccttttcattgtaataaaaccattcctgaaagtgactttgtccagagcaaatgactctaacatgttgtacttcagaggtagattgtcataactcactaaagaaagtgaccattgtatatcttaatacaaaaattacctgtttattcaagtattttttttttcaagctgaagatattttctcctgccctcccaaaacttagcacaacgcttcagtagaaaggggtataatctaactgctgtcatggccaacaaatggaaaggaatgcagaagaaataaagaagtatgtgttttttctgttctaatagagaaacaagttaaatacattaaatcataaaaacaaaaacaaaaaacaccctgacaatataaaacactgatgaaaagtctactggttaaaagtgaaaattttgaaagcagtagttgtatataatcagtggatatgccttgcttcttttcaaacaagtggtttttaaaggtgtgttgcattatgctcaaatgatatgtatttatttcataaattatataagtcttcttaagctgaatcactcaaatacaaaaacttgggctttattttaatgtttttgtaaaatggttttttcacatggattgcaaatatcatataaaccgatgtttaacatgaatatattaaagatttctttggattataattatatgaaagagttatacatttgtattctcaagacctttgttatacattgtataatgacactttctaccaaatatgaatgagaaatagtaaataactattaaggcaaaagaccagaagaggaaaactatgaggaaagacgatataaatattcctagtttttaaattaatttttaattgtgttctttctgatgacttaaaacaatgaggatctgcacacctgtagtctgaattcagtgttatcctcttttgttaaattgaaaaggaggcaaggatagaaaaatcattcactggctagagaatgcttctggtcaggtcatggattcatgctgttttcagtatataatttcattgtcaattgaaacaaagtgctaattgagcacaatattgatgggtggttcagaggtgagactagtattgtcctctaaaagggattaataataaccactcctgttgcagcttccaccaacatgtctaggagaggcatgcaggcaattatctgttcctcaaagacatttctcctggtgcataaattatcggaggcctagactagtggccctatagacccaaccaatagctcttactgtctcaaagtggtttatatcatgaatggcctttgttctgatttggtcaaaatcttcatatattttgaaactgttataatttaaagacttcacaaagggacacaatactagtctctcattacattcagttctgtaaaggcatctactgtgttactgctggataataataaccttcaaatgattctataattttaatatgttcatcatcacagatttcaaactttggtttaggtttgccttctgaagcagtactgaatacattgtttccattttgacaagtcaaacaacctttcagatatttggggaaaactaagttctgtggttgattgataactataattttggtaccccatattcttcttcattttgcattgtcttttaacgtttcctttgagaccttatcccaatgccgggtgcttcagaggaagttttctcaacctcaccactattgatatttcagaccagataattcttggtcattgggacgtgtcctgtgtattacagactgcttatgaacattcttgggagtgtttgtggtggtatgaaaatgttgagaaaactatacttcccaatttcctgagcagttgggagaagctacttgatgcaactctggcaaatgagaagcaaacaagatactagccgatgcctctgagaaagctctttaaaggatataatcacttcttgtttgttctttctcactgaatcttattccgtaaatgcattgtcaagtgatgtgacaacagtgttatgcttcaagcctaagcaagactctaagaatactggagtgagaggattccaccagtcttggtccttgaatctttctttgctcattttggcactcagtccccagatatcttgttgggggaagaatagtggcaggaactaacttttttaatctactagttttattttgtcttctataaagaaattaaaatctacataatctctaactaatagtaatagctttgctttaggaaaaaaacaagtgtccatattataaatatctcaagcttcttcttatgttcaagctgctttcaaatgtattttttttcagtcattcctatttatcatttctcaactacaatgggcaaggtaccctactaagctccagagataaagataaaagaaacaatattattatttcctcagaaagtctctgaggatagtgaagacaaaattaatggaactgctagtgttttgtgataattgtgtgtaaactatcaggagaataggagaatattagacaagataggaaatgaatctcaataaaaaagaaaatacaataaaatgtcactgttaaatcatttaaaacatatgataaaggcaggaggagctattgctgacaaattcctaattttatatctgttacctcagcatcatatatgaagacataaaacaaaacctgagttttaaatttccaaaactatctgttgcctatccacatgatttttcttttactgtgtcacagactagtatattttcaagtgcctagctaggctcaattttatttttgtttcagttttatagtatttaataacatcttttctccccaaagacctttgcttagaaaccaagagatacacaatgaggagcaagtgttgtgctaagtacccctctgtggcacgacctgtgggcatgcacctgccttcctcccagtgtgctgattgcattcctctcactcccgttgtcagatttgcttcctgagctctagactttgtcattagttatgactcatcaattgtggcataatcatatcaattccagcccagtgtcttctgtcctcatttaaatacaaatttttcttctattaccaagctatcaaatatgtttcattcactgagtctttgtaataaaaggtgaaacagcacagtctgcactcaacagccagattttttttaaaaggttgtaacattcgaatgatttgcaggcatttttctaacacattctttatttttgaaaacctaacatctatgacaccacatatgtatatctgctgattgtagttagcagtctcattcaacacttattaaaaaacatgaaattgtcaatcctatcaagttgttttttggttgtttgaaacagctctcagccatcttggaactgacccagagtgtaaaggtcttgaggattctcttcatcagtattacctgaatacaagccttctgaaaggaaaaagaaactctagcttttcaaaccagaaagtctagtaaaattcaatattgtaaattgaatttctttatttttaacaaaatataataaatggtagacaaatccattcttacagttctatttacaatcctctttcagttttatctacgtaagcaccaccatgtaggtttattatattttctgttcacattttttttcctacattttattagttgcatttccccctacatttttattttagtgctgaccttcaatttctcaggggtcagttccttgtacataaataatacttccatgtttcatgaggtcagttaccgctcaaatcggcacaaatggcagaaaataaaaacaacagaatccaaaacttctccctgagattttatcacatgttataattttagaattcccactttggtagcttttactttattgacagattgaagtttaactgtagccaattttaaaagacagaagtacgactgagttatcatatagttcagtgacaaatcatattaacattatattttgatatatctcaatacaaatacagataattctctgatatcttagacccatctcagatacttttgtttctacattaaaaatagaaataattcaggaaaataaaattggtgaaaattacaaagcaaatatccaattttttcgaaagaacaaacttgtctctaattgtcattcaatgcaatttcatttttgtcttctgtagttctttaaatatgtattcaggaaaagtttccagatctgtaaaaaaatctagcagctttcatgacttcttttggttattggtatttaacagatagttatattatgttgtaaaccacaattttatttcagaaattataatatgaatttctatattttaattaaaatataattcagatatgttttctcccctacctctttcatctgtaggctgtgggaaggggtcattcttggtttcttttccttttcagcagttttcaccttacttaccccctctcctattggataactgcttctactgaccactctaggactgaagtctggaaataggagtggtaatgaagagagaaatttctttcttaactgatagtaagtgatcatttaatctacaactgtcaattcccatgaaacttttcactttctagaataagcttgtccaacccacagcccaaaggccacacacagtccaggacagctttgaatgaggcccaatagaaattggtaaacttttaaaaacattatgggattttttttggtgatttttttttctttagcttgtcagctatcgttagtgttagtgcattttatatgtggcccaagacaattcgtcttcttgcagtgtggcccagagaagctaaacgattgaacacccctgttctagaagttcattccatgcaatggaatcccacccaagtgttcttaaagcacacttggcttcaagccatctgccatctttcattgctcatgtggatcatttccgatctgggttaaaaggtaatgcattcgtgggccctgaaatccagaaagtgaaaccccaggtcagctacttaatttgcaggatcccttttacaaacaaaagaaaatataatagaattttttttcctatggtttctttcttgacctgtcatgatgttttttctttgctcttaatttcactctgccttggaaacagggatgctcacagagcgctcaaaattactcaggatatgaccctgagtctccttgtatttggcctcagacccctgctgggtaagaggtggtgtagtggtctctaggtatcagtgggggagcaagatggcaaaaggtgagatcacatgtgagctgaggccccatgctcctggctcatgctccattgtcccatcagagttcacttacaaaacacaaattcaaagataaaattattaaggatttcaagacagtaacagtaaagttttgaaggatccactgaatgtgggttcttatacaactacagtggtcacaaacccatgaaattgacaatctaaatgtattagcagctgttctttaatttaccagcaaaacagcttatcagcctttgtcttttactctaattctggaaaataattaattaaacatcagactcctgtgccactcctaaattttggagatattcatcgagctttataaatactctcccctcacctgagtggagaaacattgctaccctcccatccaatgtggctattctagaacacctttcccaactaaacttttcatgagaaagaaaattcttattttcctcaattctggtaattatttgtggtgttttgcattgtgtcatcttgagtaggcaaaaaagtacattttttttcaagatgtccttctctgtattatccaaaagaggaacttgtacgtaactaggaaaaaggaagtaaggtggtggcccttattctctgaaggtcatcataatcaaatgcagtatcggatcaatgcagaggttccagccggcttgcaacctgtcctaaatctgctctattccacgttcaacacctttgcctactgttgcctctgtccatcaacagcagcccaagactcaccaaaagattcttagatgtgaatcaacagaggttgtagctacacaaaatcacagcctctcaaagggcatcccaggagcaacccttacataaagagatatgtttggtatttcatattgacttgttagtgagaggtcctctgattcttgaacttccctttcagaccttgagtttcccagctacttgtacagctctacatatctaattcctttaataagtcctttatcccataaaacacattactaactttgctcccctgtctgactcctgtctgatatatcattttgtacttgtattttgagttaagcaagttcttaccaagtaattttaaaatctacatcttgtaattctattgatttatttcctatggtcttagtcaaatttttgattttataatctaactttactggcactaattctttatgctgtggtcattgtatcggagacaaaatcaaagtgtcatacatcaaaaaagcaatgtggaaaggagtaaagaagtccctggaaatactaggtgctcatattgtaaaaatttaccttgggcagttatccctaggctttctacaaaaaacaggttgacattagatctagcagtttaatctgtattgtcttttatttgtcacaaatgtgtgtcatgcctataattcccagaaattacactgcttcagcctcactgatagtaaacctgtgtgctcatagctcttatgatatatatctaattagtgcctgcagggaaaatacccctaaacgttctgtcctatgttctgataacggattctttcactgttacttccatgaaagacgttttcttctcttacaataagaagaccaggatattctgcctcactatcagtttgtgtagaggttgatctgttctccattttagaaaatcagcagttggaccaatattgcttctgaaactgtgatatatgcactttgcattttataattttattcattctgagaacatcagacataaagattttgcttcatcatatattccctgactttctcctcatttttttttattccttccttcagcttgactcaggctatgcacactctgggctttgaagatatggcctagctttggtctctggggactggttgtgctgtgccaaacatttcttgtgccatggtccctctttccagaataacttgtttttacttttattattggaagtgattgtgcagaatcgatataatttcctgattaaatgtttggtaagatttagcagtgaacttatctagccctggtgctttctatttagcagggtattaattattaattcagtttctttaatagataaaggcctgttcagattatctatttctcctcatgtgagttttggttgattgtgtccttcaaggaattggtacatttcaccctcgtcattaaatttttgtgcataaagttgttcataatattcctttactatcctttaatgtacatgggatcactaatgatgtcctctctttcatttctggtattaataatttatgtcatctctatttgttttagttaatcttgatagaagtttatcaatattattgatgttttcaaataactagcttttttctttcatcagtttttttctatttattttttggttttaattttattgatttctaattcaacacaattttgaaaatgcataaaggaaagcacagtattataaaaggtaccaattctgttgaaacatacttaaatattttttaaataatttttaaaattatactaaaaggttttttctaatgcattaataagacaacatgtatgaactataagcaataaattttatttgttaaaggcagattagtgttaaggtattctctttaatttgaagaaattattaaaccatgaggtaaaatttgataaatcctcatatatatcatgttagatatctaaatgatttatttttgttgtttctttataatttatttttattgcttgtctgtttaccaatgttaaatatattgatttgtaaggatttactcttccaagtgtaactaaggttttcataattcacaccagatgaaggcaggtgtctctcaagaaaacttcaaattttacaagattatttggtgaaactccaactagagtaatttttttctgctaagatttaaaatggaaattcttaatattttgcagcttggaagagtaatttctaaaaactcagtgtgattttcagcttctgattaggatgtagaaaggtgaaaagaatgatgctcccacccttaaggtgagaaatatttgaattatctacaaagtcataagttgttttcagcccatcagagatgaagttgcatggcaaccaagtaaactggttccagagagggacaagccctcaaggatggaaaggacacaaaatgagtttcatctttgaccaatcaaaaaatgaagaggaagtcaccatataatcatataagaaatcagctaaactttaataaattcttaaaggctaaatgtgggtaaattgtaagtttagaatagcaggaggcctcaggcacaagaaatggtcatttcttaaactcttttacacggaactttgtctgttgaagggaaagactgggaactgggcagaagatgagagagaccctgctgcatagtgcaggcttcgggtaataatcagttgctgctgggggactggcaaaaagccttgcccactaccccagaacattctttcttaggaagcaaagctttaagccactatagaagagacagcacaactgtcatttccactaatcacaggcaaagatgcactgaggcttgggaacaagtggaagaatgcatcctatatctttggaagagtgctaggaaacagttgtggctaagattctataccaataacaagaagaagcctttaactactatagagtggtaaatatttccacccaaaaccaaccacagatccaagacagagtttcattgtcatagatgagttggacacaatgcaagaacactaagaatgccccattttgagaaaaaaaaaaattcagcttaattcaatgacagtagtctaaaaccaacataacaaaaagacaaaaaggaatgaaaacttggacttttttcacacaggacatacctaagattgaatgaggctgagacagggcaacataaaacaccccactttttacccctatgccaagcctgataccaaataataagcatcagctgtctacgtattgagtaagggaaagaggaaagacagagaacacctcggcggtgcaggaaggtaaggatgctgaaagctgagaggggaacagaggtactaaacaaaatcctccagcaccccaggacccaccttaaacccagccaacatcagccattcctataggaatttgaagcctgtgtggactgaaggtaatgataatcacgataaaatctatatctagctcaaacccctgactaaaacagtttgctgtctcatacaaattgtcggacaaaatgatgtgctcttttgctggcataaatattattttaagagtaattactgctacctacttgattttggaataaaacatatgctagccttagctaggcaatttgtttttctatattcagaagtagcataataaataacagattcttaaaattctgatagaatttacttatctgaggatttgaaggaatgatctttaatagactaagaaataaatattgaaatgattgttagatacttcctgtaaaatcctatattctttatctttagttcctattattaatacatcttagttgttacagtccttacatctttccatctctagcattcacatttattacaatgaagctattttaatacttaaaattttttaattgtgcatattacacagtctctcttattgtcttggttaaccttccacaggtttctgtatcctaaatgttttctcaaaaactaacttttggttagaataacattctttgttgttgctttaaagatttttgttcattaactatttctattgggtttcctccactgctctttctccaatttttaattgaaaaatagagctcgtataattttaatctttaataataaatgtatttcaatgtacatatttttaccttaaattatattatgtcatgttgtcatgtaaatattgcccctctagctttttagtatttaagcctggtgtgttataaaataattttaatgttagtagttatatacatatatattttcttttaaattttaacttatgtcaacaacatgttttggctcttattaaaaaatttataaaagtcaggatcctttaattactgcttttaacttatttgcatttattgtcattattgttacatttaacttagttcggccaatttacatcatattatacatttactcacatttttagtttgtttcctttccccatttcttctattgtttgtctatagaacagctcactatattagtttaacaagtatttaaatttatctctgtggtaattatcttaacattttaaataagaaaataaatattactttcttaaactattgatatctgtatattgtatctaaagatacatttgctttgtcatagtcatgtgtttcttagatttcaatttcatctttctcattatatagataatttctataatttcaattctgaattgcttttgttttaaaatttgcattctatttttttccttgtttttctcttttctctaaactataaactgactctctactcaactctcttcttatgaaaattgtataaaatatgcatggaggtatcaaaaatattccaaggcattaaagattacagggctaaaataccgaagaaaacagcacttcagagaattgagaacaatatggactatcccttgacccatgaaagattttctcacatgtatgtggctattgatagaccaaaaacctaagcagaaatattcatagtcttatagttttaagagaataaaatatatggctcaagacttatcaatgagaaaggccgatttatacaccccaggcttcatttgacacttcaaaggtttaggaatattaatggaaataaatagattataattcacaataattgcagtttggtctcaaaccagcttaatcactgattatatgaatatgatctgtaacacaccttagataaccctccaaaaaacagagttagagttaaccagaattaactattggctgcaatttcattagaatattagaaatattaagggcaaaagccacatttaaataggtaaacttaacatttttcaaaaatgttggaagccaggcatggtggctcatgcctgtaatcccagcactttgggaggctgaggtgggcagatcgcctgaggtcaggagttccagaccagcctgacaaacatggtgaaaccccgtctctactaaaatacaaaaatcagctgagcgtagtggtgggcacctgtaatctcagctacttgggggttgaggtgggagaattgcttgaacccaggaggcagaggttgcagtgagccgagatcgtgccactgcactccagcctgggcaacaagagtgagactctctcaaaaataaataaataaataaaaaataaaaaaaagatggaaaaactgtaagtcacagtctcaggaagtgccagagtgaagcatgataaatatggagacaactacatagctcatattagagaattaacgacaaagagactatctcaaaaatagttctaggaaaaagcatattaccttcaaaaagtggcaatatgacttagggatgacttctcaaatggaagccaactggtaactagaattttattcctaataaaatattatggaatatgagaaaaaaataaattcatgttcaggaaaacaaaaaataagggaactatctatatcatttatacattacaccaaatgaaataataatgtctttcaagcagaagaaaaattattttacatgtaaatgtagaaatttagaaatgaaatcaagaaaagaaaggacaaaacatctggataaatctaaataaatagtgactatataaataaaatccatcatataaaatttaaaataaatatcaacaaaactacctaacaaaatatcaaaagtattataagatcttcatagtctaagaaaagtaatgaaaattttactttatactcagacactaataagtcaaggaatcatgaaataatatctagggcaaaatcaaaagatacttaaacttataggagattataagggcatattggagaaaaaaatgcttaattgagaaaaaaggcaagaaagagcaagtcgaaaatacaacagatggaaaaatagcaaagtggtagaccacaatcaaaatatcttgagttaaatataaatgattttcatacttcggctaataaaaatatctaaaatgaattttaaaagtaattgaatgtgttttattaaaaataagaactgaggaagtctgaaaaaaaaaatgtaaaaatggtctgttaggctgacataaccaaaagaaagctgagatagatgtactaacatcagatgaaataaatttagtggcaagaagcagtactaagacaaaagaatacctttcaaaatgataaaatgagcagtataccatgatgtgacaatttaaaatttgtattaatgtaataatgggagaaatataatgcatccatatcatactggggacttttgcccacttttcttacacggttggaagaagtagaaaaaaatgtaattaagaataataaagaattagatatctctattagcaaatttgatctaattgatatatatagcataatattaaactcgataaacttaaaattgaatatgtaatgtgaatgcacatttaatatttattcaaatgctctatattgtgtcatagatcaagccgtgacaaattttcataattgaaaatagaaataatacattttctgacatcagttaaactgttagaaatcatttacaaaaggacaacttaatccacaaatattttaaaatcaagcaacatattcctaaataattcacaagtcacaaaattagtctcaatggaaattagaaaatattttaagaaaatgagaataagccgggcgcggtggctcacgcctgtaatcccagcactttgggaggccgaggcgggtgatcacaaggtcagcagatcgagaccatcctggcgaacacggtgaaaccccgtctctactaaaaatacaaaaaattagctgggcgtggtggcgggcgcttgtagtcccagctactcgggaagctgaggcaggagaatggcatgaacccaggggggcggagcttgcagtgagccgagatcgcgccactgcactccagcctgggggacggagtgaaactccgtcttcaaaagaaaaaaaaaagaaagaaaaagaaagaaaatgagaataaatgtatgacatattgaaactcaagaaaatggatatccttggttacacaaagtcatacagatggtaaaatggtcattggagactcagagcggggagggtgacagaggagtgagggatggaaacttgcctagtgggtacagggtacactattcaggtgatgactatattaaaagcccagacttcaccacaatacaataaaccatgtaaccaaaaaccctttagccctaaagctattgatttttttaaaaaaactatagccttaatggtgatattgcaaagaataaaagattaaatgccagtagtccaaatacccacaggttgaaaatagaacatgcttaaaaatggtacatttaaagaagctgaaaaccaaacagtaaaccaaatccaatgaaaatagaagtcatacaagagatattaatggaaaataatacattcaaaaagaatcacataatcaaggggatcaaaaaaaaagccaaaagtttttccttgtaataatgttaaaataatcttttacaaaattcagagaccaaaaaaaagtgtgagagagagagagagggagggagggagcacagtaatataaaaagaaaaggtattactactgatcctacagaagaaagaaattcaaagttatgagctacattattgcagtacatatttgacagtttcaataaaatttgtaaaaaacttgaaaaagtcacttaccaaaactgacatgagaagacataaaaatcggaatattcctgtaactatttttaaaatccataataaataactttttctcatatatgtacaaaagttctaggtccagatgtttcactagagaattctccaaaacatattaacaggaaagaaaactaacattacttacatatttcccctattgaaaaatttctcagcttgttttataaggttaccgataattttaacatagaaatgtgacaaggacattagaagaaaagacagtaacagtccagtctctcttacaacctagctaaaaataatttaaatattatacataaaactccgcaatatgtaaaccacaaacataggttgggcttgttacaggaatgaacgtgttttaatattcaaaattttaaaactgcagtgtgtttttcttaacagaataaaagccaaaaatcatatgacattctctataactaaaaaaaaaaactccaaagtctatgagtgacaaagcctattacctaagttgcaatgatgaaaaaatatttaaattattaaaggctacctccaaaatgactgtgatgagcacctctgtaatggcaaagtgttgaacattttcctactgacattgggaatgagaaaatgatactgactatgatcaactttgttcaaccttacacctgacaaaattgctagtgagaaagtaaagaagaaataaaaaagatataagaacttgaggagaagtaattaagataatttttcaccaaaaaaatgaacaatttacagataaactcttatatgaatacatttacaaggtatgtgcctataagataatatttgaaatcaattgcatttcttttttaaggaaagaagaacttctaaaattgaaatttgaaaaaaaaagatacctctaacaatacatcagaaacatcaattatacaggaattaattttctaactagaatacaaaatctgaaaatgaaaacccagaaagcattatgagaaaattgttgaaagtcgggacattagttacctggaaaaggtaggcaagtattatcctaggaatgagtttaggagaattctgggttgtcagtaatagctaattccctaacctgcatggttatttatgtttattgcaaaatagtagcttactttttttaattttataatatccattgaatgtttattatgatatacccattgagatctatgtttatgatttgtatattttttaggggtgtgaaacaacaataaaacatttatttgaaagaaaattaatgaataacagtaaattttattatgacatcagatgatttgtacatctgatagttcttgacatatcatctatatttgaatttcttgtttgaataatttctctaaaaatgtttttagtaccctgctttgggtagcaaaccacttgagggaggatgagtctgggaatattttttaaaatgctctcaatgttcaacagcatttcatttggatataaaattctacattatagctgttttccttctataatttttttataaaatatatttccataggttattggggaacagatggtgtttggttacatgagtaagttctttagtggtgatttgtgagattttggtgcacccatcacccgagcagtatacactgcaccctatttgtagtcttttatccctcacccccttcccaccttttccccttgagtccctaaagtccattgtataattcttatgcattttcatcctcatagcttagctcccatttatcagtgaaaacatacaatgtttgattttccattcctgagttacttcacttagaataatagtctccaatctcatccaggttgctgcaaatgccatgaattcattcctttttatggctgagtaatattctatcgtgtgtgtatacacacacacacacaccacagtgtctttatccacttgttgatttatggtcatttgggtaggttccaggtttttgtaattgcgaattgcgctgctataaacacgcatgtgcaagtatctttttcgtgtaatgacttattttcctctgggtagatatccaggagtaggatttctggatcaaacggtagttctacttttagttctttaaggaatttccgcattgttttccatagtggctgtactagtttacattctcaccagcactgtagaagtgttccttgatcaccgcatccatgtcaacatctgctgttttttgattttttgcttagggctatttttgcaggagtaaggtggtatcgcattgtggttttgatttgcatttccctgatcattagtgatgttgagcattttttcatatgtttattggccattatgtatatcttctttggagaattgtctattcatgtccttagttcacttttgatgagattgttttttttcttactgatttctttgagttccttgtaggttttggatattagtcttttgtcagatgtatagattgtgaagattttctctcactctgtgggttgcctgtttacactgctgaccattccttcagccttgcaaaggctttttagtttaattatttcccacctatttatctttgtttttattgcatttgcttttgggttcttgtcatgaaatccttgcctaagccaatgtctagaagtgtgtttccaatgttatcttctacaatttttacagtttcaggtcttagattcatttatttatttgtttatttatttttgagatagagtcttagagtcttgctgtagccccaggctggagtgcagtggtgcaatctcagctcactgtaacctctgcctcctgggttcaagcgagtctcctgcctcagcctcccaagctgggattacaggcacatgccaccacacctggtttacttctgtatttttttagtagagatggggttttgccatgttggccaggcaggtcttgaactcttgaccttaggtgatctgcatgtctcagcctcccgaagtgctgagattacaggcgtgagccacagcgcccagccagatttaatttcttaatccattttgagttgatttttgcagaaggtgagagacgaggatccagtttcatttcctacgtgtagctagccaactattccagcacaatttgttgaatagggtgtcttttccccactttgtgttattgtttgcttagtcaaaggtcagttggctgttaggtattagggtttatttctgggttcttttttaatatgccattaccttcttgcaatccagttgcagtaaaagtttgatagaatgctttggtcctctgcaggtgactatttattctcggttattattatcttatagttagaattttgttttgacttaaccgaattggcttagaaacagaaggcacattattttcaagagcatataggatattttacaaaataaaacaaccatatgctggctgtatagcaagtcacagtcaatttcaaggaatttaaatcattcagattatgtcctctggccaaaacatctggagaaaagcaccacattttgtttctttgtttaaaattctatagagcatatatgtataatttctgttatttctgataaatgtaagatagtgttaaagtggtttagtacttcttttctgtcctccttgcacagtcacccttactgtttttggatttcttgtggtttgtgttgtgacacaagcctaatttttcctcaggttttaaagcctgctacttgtttctgaagtactgagtcattgctcaagcgaatattttaatatatatatccatatcttatcatttcaccaaatttagatagttaaaaattttcaaagatgacattgatacatttctcccagtagttacatttattatgccttagaaagcaataagaaaaggactaaaaaacagactgggatttggcaattcaggaatcaaataattatgttttaaaaagatattgtcgattctcctgcctcagcctcctgagtagctgggactacaggtgcctgccaccacgcccggctaattttttgtatttttagtagagatggggtttcaccgtgttagccaggacggtctcgatctcctgacctcgtgatccacccgcctcagcttcccaaagtgctgggattacaggcgtgagccactgcacctagcagagcttacagtgagccaagatcgcgccactgcactccaacctgggcaatagagcgagactccatctcaaaaaaaaaaaaaagaaagaaaaataaataaaaagatattgtctaaagaaatgtagacaagcatgacatttgtcactacaatgcttattcttcacaatttagacattgattaggtaagggttatgagagcaggaatgaaatagagacaaattaaaataatatgaatgtaaacttaaggttgactgtagatttccaaaccaaagaaactgttatttattataatgaaaaatgaagaaaaggtgcaaattgtgagtgaagtgaatttacaatagacgaaaacactgagccaagggaatgtctcccagactcaaaatcatgaaataaaatgagccagtgaatgtaacagtgaaaacttcaaaaatttgaagcagaactgtaaacctgctatgtcacagaagacaaaggcttccatgagtattggctatagcaaataagcaattacttatgaacataaagaataactgacttgggaaagtaatgactattatttcctagttcctgaatatttctgacaagaaaagcaataatttggatcaaccgttatattttgataaatactttactttctaattctacatatttctgcatttcaatttaggtgggatggctatagtaatttttaaattacctattatttcttttctatctagttgaattgtttttgaagtcaaagtcaaacctcttttgactttatgtatgccatctagttcttactgaggagcatcggcatgctgctgaaacctctatttaaattacctatttttaaagtttttctaaaatcctttcatgaatattatttcttttactagaagtaaaagaaatatgtagaagtgtagaagtgttactacatcacacttatgtagaagtgttactacatcacacttctcaaaaaattatataccaagaaatacagctgggcacatgcacaaagcaatgcagtagtatcaaggaaggaaattgaggaagaaatacatatatctaaaacaatccttcattaaaccaagataattaaaagatagactaaatttaatgaaattttaaaatcacatattactagatgatgactggaaaagaaaaccttttgaaaaataaagactcataattttgaactactttatattgaattagaagttcggttaacaataaccaaccaagtaaattttagtaattgaaatgaagtaccagaaggaataagtcaagaaggaaagcagagaaaatttaggataattaaagaaaattatgattcaaagttaaataaaatttaggcattgagtctatgtaaatggaatagaattaaatagtaaagagaacagaatgtaagcaataacaggtaaaacaggcacaaggccggtcgcgatggctcacgcctgtaatcccagcactttgggaggccaaggcgggcatatcacgaggttgggagttcgagaccagcctggccaacatggtgaaaccccatcccaactcaaaatacaaaaattagtcgggcacggtggcacgagcctgtaatccccactactgtggaggctgaagcaggagaatcacttgaactagggagtggagtctgaggttgcagtgagccgagattgtgccactgcaccccagcctggatacagagtgagatttcatctaaaaaaaaaatagtagcttaatgttatattttaatatcaaatggaagatacagaaaagaaggatttttttaaagaaaaaataattttatgagacctctttatagcccacttacagagtaaatatgtcaaagaaatgtttgccatttggttgtttttatgttttggtcccattgttcaacacgaaaaaggaaaataacatttgcacaaaacaattgtacaagtcattttacatgaaaattcaaattatagttaccaattggcttttgcttacagaaaaagaagtttagagtagtataaagttttgataatatgggaatataactgtaagtaaatgtgttggttaagctctatagaagtggttcatcctttgagaatgtcaataaatgctccaggaagaacttttttatttaggaagataaaatataaataaactaaaacactaaaatatgaactaaaaacaaaagtgtgaaacaactgaaaagttgaaaggagtatattagtaagtggagagggaggcaatttgatggggatatttgaaaaagttggaggatacatggattgagagaaagaaaatccaggatggaggaaaactttaaaaacacttgaaaaccacatagaaaacacgcaagaaaaatacgaaagaaaatataaaaccacaactgagaactataactgaaattataatcatttttcacaatataataatatatgtttttaccaacccttggaataaagtttaaaatttgaatttatttatatagagaataatacacaaccttacaacaaaatatataatttaaaaatcctacctatttgatttgaaagacttgtagaaattaacaaaattattacgtaggtttgatttctcatattttttacttaacattaaactcaattattttctaacagttttgtacatcaaaagtccaggcagactccaccagtttttttacttaggaactcacagggtgatactgaagatatggctaactttaagtttttatctggaaactaggggaaaagtcacctctaagctcattcaggttgttggaagaattcagtttcttgtgattgtagcactgaggctcacatttcctctggatgtccacttgggattgcacaagctgctagaagacaccctttggttcttgcatgtggcccctttctgtcttcaaaggcagcaacaatacactgaacccttcttgtgattcaaatcactttgacttctcgggctgcaagccaggtaagactccttttttccttcttttaacttttatttcaggttcagtggtacatgtgcagatttgttatataggtaaactcgtgtcacgaggctgtggtatatagaacatttcatcatccaggtactaagcatagtacccagtatgtattctttctaaatcctctctctcctgccttccaccttctagtaggccccattgttggttgtttctgtccacgtgttctccttatttagctcccacttataagtgagaacatgcagtctttggttttctgttcccgcattagtttgctaagaataatggtctccagttccatccatcttgctgcaaaggacatgattccattctttttatggctgcatatattccgtggtgtatatgtaccacattttccttatccaatatactgttgatgggcctttaggttgatccatgtatttgttattttgaatagtgctgcaatggacatatgtgtgcatgtatctttatggtagaacaatttgttttcttttgaatatatatccagtaatggtgttgggtcaaatggtaattgtgtttttagttctctgaggaatcactacactgcgttccacaatagctgaactaatttacacacccaccagcagtgtgtaagtgttcccttttctccaccacattgccaaaatctgttgctttctgattttttaataatagccattctgacaggtgtgaaatggtatcttgctgtggttttgatttgcatttatctaatgagtggatgttaaggtttttacatatgctcgttggcagcatgtatgtcttcttttgaaaagtgtctgtgcatgtcctttatccactttttaattagtttgtttttatttttattttttggcttgttaattggtttaagttccttatagattctagatactagacttttttcagaaggctacttcgcaaaaattttcccccattctttaggttgtctgtttactctgctgacaatttcttttgcagtgcagaaactctttagtttcattagatcccatttgtcagtttttgcttttgttgcgattgcttttagcacgttcatcatggaatctttgccagttcctatatccagaatggcatttcctaggatatcttccagagtttttatagttttgggtttcacatttaagtatttaattcatgatgagttgatttttatatatggtataaagaaggagtccagtttcaatcttcttgcatatgactaatcagatatcccatcaccacttattgaatgggaacttctttctttattgcttgtttttgttggttttgttgaaaattagatggctgtagatgtgtggcattatttctgggctctctattctgttccattgttctatgtgtctgtttttgtactagtgttatgctacttgggttactgtggccctgtagaagagtttgaagtcatataatgtgatggcttcagttttgttctttttgcttaagattcccttggctatccagggtcttttttgagggctaggtgaattttaaaaatagattttttctagttctgtgaagaatgttgttggtagttctatagcaatagcattgaatctgtaaattgctttgggcagtgtggtcatttgaatgcctaaatttattgaaggttatttaacatgtagcagtgttgaatgcatctattgtgataatcatgtggtttttgctttttatgcatctattgagataatcatgtggtttttgtctttagtttacatgattaatcacatttattgatttgcatatattgaaccaacctttcgtctttgggataaggtctacttgatcatgatgaattagctttttgatgtcctgctgcattctgttcgctagtattttgttgaggattgttgcatctatgttcatcaaggatattggtctgaagtttttttttatttttttattttattttttattttgctgtttctctgccaggttttcatatgaagatgatgctgttctcatagaggatgatgctagtctcatagaatgagattgagaggagtccctcttcttcaattttttagaatagtttcggtaggatttgtaccggctattctttgaatatctactagaattcagctgtgaatccatctagtccttggcatttttttttggtaggctatttattactgattcagttttgaagctcattattggtctgttcaaggatcaatttcttcctgcttccatcttgggtggatgtatgtgtccaggaatttatcaatttttcctacattttctggtttgtgtacatagaggtgtttaaagtagtttacggtggttatttttttttttctgtgggatcagtggtaacatcttctttgtcatttctgatagtatttatttggagcttctccttttcttaaaagtctaggtatccatatatctatttattgattttttcaatgatccaactcttggatttgttcatctttttattttttttttttatgtctcgaacgccttgatatcagctctgatttttgttatttcttttcttctgctagttttgaggtttgtttgcttttgctcctctggtacttctagttgtaatgctgggtttttagtttgatatctatcattttgatgtgagcatttaggactacaaatatccctctgaataccactttagctgtgtcccagagattcttgcttgttttatctttttgttattttcaaagaatgtcttgatttcttccttaattttattgttcacccaaaagtcacttaggagcaggttgtttaatttccatgtaattgtatggttttgagtgattttctttgtactgaattctgtttttattgcactggtttttttttgtttttttattattattattatactttaataataatagggtacatgtgcacaatgtgcaggttagttacatatgtatacatgtgccatgctggtgtgctgcacccattaactcgtcatttagcattaggtatatctcctaatgctatccctgccccctccccctgccccacaacaggccccagtgcgtgatgttccccttcctgtgtccatgagttctcattgttcaattcccatctatgagtgagaacatgcggtgtttgggtttttgtccttgcaatagtttactgagaatgacgatttccaatttcatccatgtccctacaaaggacatgacctcattattttttatggctgcatagtattccatggtgtatatgtgccacattttttattgcactgttgtctgagagtgtcgtttgtatgatttcagtgttttttttttaaatttgctgaagattggtttatgtctgattgtgtgttccattttacagtatgtgtcatgtggtaatgagaagaaagtatattttgtcatttttggatagagcgttctgtagaagtctattaggtccatttgatcaagtattgagttcaagttctgaatatcttcattaattttcttccttaatgatctgtctaatactgttagtagggtgttgaagtcttccactattattttgtagaaatctaagtctctttgtaggtctctaagaacttgttttacaaatctatgtgctcctgtgttgggtgcatgtatatttaggataattaggtctttttgtttaattcaaccttttaccattatgtaatgaccttccttgtgtttgttgagttttgttggttcaaagtgtgttttgtctgaaattaggattgccacctctgcttttttatgttctcctttcgcatggtagattttttttccatccattcattttgagcctatgggtgtcattgcatgtaggatggggctcttaaattcagtataccattgggtctttttctttatccagcttgccactctgccttttctttgaggcatttaggccatttacattcaaagttattattgatatatgtggatttgatcctctcatcctgttcttagctgattattatgcagactggtttgtgtggttgctttatagtgtcactggtctgtgtacttaaaggtgtttttgtagtggctgataacagtctttcctttccatatttactactcctttcaggaactcttgtaaggcagtctggtggtaatgaattccctctgaatgtgtttgtttgaaaagatcttatttctccttcacttatgaagcttagtttggctccatctgaaattcttggatgaagattttttttctttaataatgttgaatatagacccccaatctcttctggcttgtaggatttctgctgaaatttctgcttttagcctgatggggtgccccttgtaggtgatctgccttttttcattagcttactttatcactttttcattcattttggccttggagaatctgatgattatgtgtcttggggatggacttcttttttagcatcctgtaaaggttctctatattctttgaatttgaacgttggcctttctagagaggttgacgaagttttcatagatgatatcctgaaatatgttttctaagttggttgctttctccccatgcgtacagcacaccacagccaccatttagagaaaagccccatttcttgctgctatgggcccttgaccccctgttccccaacaagcagagcctctagctcaggcaagcagtgcagctgcttcaccctctggctgaacactcccagtagcagcagctccacatttctcagagatggagctcccaggggcaaccaaaagtccctctgccactgcctctccagtttaacttccctgtttacccttgaactagggaaggagcaaagactccgagtgctttatcccgcaagttgtagttgctctaatgagaggaggccagtctgtctcccacgggtcctacccacattctctgctagtcaccagacaggatccccccagcgtgggctcacagtgcagctgccccatgtcaggctgatcatgctaattgattgcagttctgcatctttctgcaatggagccccaagtgacaagaaaagacgttgagccacagggtctcctctgctgcttccaagctggggaagtaacataaagcctatgatcatttcagaactatggtgtgcagcctggatgcaccaagccaagatctgcagtgagcactcaagtgggagaggagcctacactgactttcaaaacattgagaggaagcatagctgcaacccatgaggaaatacggaggagccacatgactgagcaggagcctacacagtgaccattacacttcagcaccagctactagatcacaccccaaaacttcaacaccaataatactttgctatcataccctgctgtgaaaagaaagacaagaatttagctacaaataaaggccctaaacaaagccttaggactctgaaaacatggaaagaagtctactgactgtactcaatttacactgcaattaaaggaacacccacacacacacacacacacagatgagaaagaacctatgcaagatctctggcaactcaaaagaccagcatgtcttctttcctcccaaagatcacactagttccccagcaagggttcttaactaggctgagatggctgaaatgacataaattgatttcagaatatagataggaacaaagatcattgaaattcaggggaacatcgaaacctaattcaaggaagctaagtgtattagtctgttatcaccctgctataaagaacttctgagactgggtaatttataaaggaaaaagatttaattgactcatagttctgaattgctggggaggcctcagaaaacttataatcatagctgaaggtgaaggagaagcaagtaacttcttcacagggtggcagaagagagagagagtgaagggggacagtcacttttaaaccatcagatctcatgagaactcactcactatcatgagaacagcacgggggaaccaccaccatgatccaatcacctcccaccaggttcctctctcaacacatggggattacagttccagataagatttgaatgggaacacagagccaaaccatatcactaaggaacaaacacaaaaaataattcaggtgctgatcggtgaaatagccagtataaaacagaaccaaattgactggctagagttggaaaacacaccacaagaatttcataatgcaatcacaagtattaacaacagaatggaccaagttgaggaaaggacctcagagcttgaaaactggctctcagaaataagacagtcgggcaaaaataaataaaattttacagagctcattgtattagattaggtacacttggataatcttcctgtcttcacatcaactgattattaacattaattacatctgcgcaatccattttgccatgtaatacaatataatcatcaaagtaacactgggaggctaaggtcatgaccatctaatattctgtataccacacaattgtattgctttctgaggtcactgaacactttcagaattcatgaaagttggatactcactataaataagatagatatggctagcaagaagaaaaatatagggattctatacttaaaagatacagctatttccatttatataattgtcacaataaaaatttaaatgtgaataagtgaatagcaagtatagaaagtttagcaaaataatgagaattagatatgtaaatgaatttttaagatagtctcagaaaaagtgtaatatttgtcatttatcctgaaatgtcaaaaattttcctaagcagaactactcaccaccaatttctcagtttcatccctgaaaaaaaaatcattcaagtggatttattttggcaaagtgaaactgtgaattgcttggctccagaacagctgcccatactcagcaggactgcattcccacactccattcacccttaccccatcccttccaggaacacttggactaggatccagctctagatctgcaagaagttgtgttccagctcttaaatcattagtaggaccagattttactcaaaaaactattctagcatttgaaattatttccactgctttgttgcttacactgaaatcgtccctcaaaaaatataagaaatagaatatgagccctgcttattctttaggacaaaatttaggatggtgtatctaataaatggattgtaattaggaagatggttttacatttgtccctagattcttctgtttttctcaggcctctatgaatctttctctctgagagatcccgacttgctgagagcaagaactattgaaaggaaatgaagtaaataactgatggttgcccatggcaattaggaaaataaagagcaaacttccctctttgaatattacttagtgtcaagacttaattatactcattgactatacaagtctaaatatttgggcacttatatttttgtatttgggcatatgatattacaaaataattttgagagctaagagacatacgtatgtattttagaactccaatagcagtaactttctcagtagcatatagttttccaatctgttggaaaaagcttggctttaactaggagagataagtaatagagctagagtttcaattctgttcaatatgaataataatatttcaccagtagaaattaaatatgtataatcatgtgacagtaatactgatatgatctgagaaatgcattattaggcaattttgtcattatgcaaacatcatagatgtttacaaaaccttgacaacatagtctgctacatatctaggctatatgagatatagcctattgctcctaggctacacacctgtacagcgtgtgactatactgaacatgtaggcaattgtaacataacggcaagtatttgtgtatttaaacgtatctaaacatagagtaggtatagtaaaagtacagcgtaaaagatgaaaaatgttacgtctatattgggaacttaccataaatggagcttgaagactaaaagttactctggataagtcagtgagtgaatggcgagtgaatgtgaaaccctaggacattactgtatatgactgtggattttataaaaatgatacacttaaggaccatgaaattaacattatcttactataccttttaatctaatatattttaacgcttttatatgtttcaacgctttgattttttataataacatttagcttaaaacacaaacacattgtgcagctatacaaaaatatcatcttttatagctctgttttataagattttttcctttttcagctttgtacacctttttgttaaaaagtaaaatgcaaacacacacattagcctaggcctacacacgatcaggatcatcgatataattgtgttttaccttcacacctcatcccactggaaggtcttcaggggcaataacatgcatggacctgtagtctgctgtgataacaatgccttcttctaaaatatctcctgaaggacctgcctgagacagtcttacagataattttttttaataaataagagtataccctaagataacattaaatagtaaagtatatacataaatgagtaacatagtaatttattatcattatcaagtattatgtgttgtacataattatatgcactattcttgtctatgattggcagcacgataggtttgtttatatcagcatcaccaaatgcacttgagtaatgcattgagctttgaagttataatggctattatgtcactacatggaagatatttttcagctccattagaatcttatgggaccactattttaaatgcagtctgtcattgaccaaagcattattatgtggggcatgactgtaaacgtttcaaagaaattggttttccctttcattctattactgttccaccactagctgttttgtacgtttctctttctgtgctgttccttaaatgtagaactcctctaaatgtatttcttttatttatcctgtcccagaacaatctcattaacattccttggaaatgtttcctctcatcaggaatgctcttctgaggcctgtacctgaatgaccatttgtccccattaagactcatttgggggcaagtaacataaatggaaaaaaaaagtagactaaagtaactaagcccaagggtagtatgatttaagctaaaggtgatttcaggctccaagtaaagtaatcagggttcagcttatctccatttgttatctcttcttctagtgggttggacccattttcaaagaatcccttcccttacatagcagtccatatagaatctcacttcaaatacagtttaaagaaaaaaaaaattatcttcaaaggcaaaagcaaagtctggaaccagatttccattgacccagcctggatgctggtattggatgctctattacgcttaagtgagataaatagccatttctggccctctttttatttgtttacaatgccccactttggagaaatgctggagtgcatttaagaaggttctattcatgaatagaagaatctcagttgtatagaaaatgatttatttgaaattacctgctataaaaacttcccaggctcattgctttttggatcaactctgtctcttctacttccttgtactgctgtctggaagaaccctggctcacaatggtgcagaactttttatcctgatatctgaagtaaattgatctgagtttatattaggttggatcttagtgcccatattatctactgggagtttcccagcctggtatgatggagcttagaagagagtaaattagcttttacaagtcagtctctcaatatttatttagtgagtgagtggacaaatgaatgaatatttcttggaggtattattcattttgtgttcccttcatacttcaaattattttttacctttagtaagaaatggatactgacatggctttaatgaatctcctccaaaattcaagtgttgccaatgtgatagtcctaagaggtcaggcctttaagaggtgtttaggccatgagagatcctctctcatgaatgggatgaggtgatcttataaagggtcttgacagagagagttggttctctcttgccccttccaccttccaccatgtgaggatgcatcaagaagacctcagagcctggtatcttgatcttggacttcctagccaccagaatggtaagaagtaaatttctgttctttataaattactcaatctatggtattctgttttagaagcacaaaatggtctaagacacataattttaccctttctaaatccaaattgaatgcaattttatcataaagttttatcatttctctaataaaaatgtttttaaattttttgaaagtccacaaatgcatatatatttacatgcatatctatatgaaggtccaactttgattctgctttgttttggctttcttttttgtattacttttctccaaagagtaaaatacacacttgttttattctcttattcctacagcacctaacataattcttactaaaaaatattatttaatgaagaaaattattatataatacattttgttgatacattattttctacatattatgtgtcaattttgttccttactatcctcagctggaatccatttgaagagacagaactgtattgtgtagattcaagcaatacatagtaggataccatacatactgtagggtttggctctgtgtccccacccaaatatcaccttgaattgtaatctccataatcctcatgtgtcaagagcaggaccagatggaagtaagtagatcatgaaggtggtttcccccatgctgttctcattatagtgagcgagttatcttgagatttgatggttttataagcatctgacatttcccctggttgcactcattgagtcttgccaccctgtgaagaaggtacctgcttctcttgcattctgccatgattgtaagttttctgaggcctccccagaactgtgagtcaattaaacctattttctttatagattactcagtctccagtcttgcgtatgtcttcatggcagtgtgagaatgaactaatactcatataatggatactaacaagtaaatctttatttaccacttattagaagcttgacttaaccaattatcaaattttatataagctttaatgttattgggaaatatccttttcctgtaaaaataaatgagattacctacctgaagtaccttaggcctttctaatattttcaattttcattaaatgtttatttttatgtatctatagatatcttgaatatgtattgtaaatattatatgtatgtagaatatatgtattctagtatttcttccagatagcacttaaaaaccagtgtttgcatttttgcatgtgagcaagcaattcctacttacaatgatggaagaaatagataccctggaagaaggaaaattaaattcatgctttcaaagcatccttcccaacaaatccaattcatcttttgcacagaaggaataattagatgaagatatattttaagtcagattgttagtattttggccacatggctacatcataagtgtagtttaaaattctgttcatttttatttttttaaatcaaaacactcattgaactgtacttaatttttaaatgcaaaatacataaaactcttgcatttcttggaaataaattctctttattctactaataaataaacattgttaccaccattgaggcaaatgacagaaattcttacaattgattatcctatatgggtatgaaaactttaacatgctcctctaagtaactgaatactacagagtgattttggatcaatgtggccttattttgaatataacatacaaaatcattgagtgttttatgatttatcttcattttaactcaagctttgggatatatgaagacagaagataaatcaaaatgtgtcacgtattatattttctgaagttattaacatatatctagcaaaaggtaaaatagcacagatataccaaccaaattttcatgtgaagaaaatattttatataaataatgtttcttcttttatatgaaatcactgcaaaaatgagaaagctactttttatattccccaatgaatattccccagtgctgtgattccaagttcagtaaaatttagaaaatcatggccaagaaatttagtagaccgaatgtaccttcactttctggaatgtacttgtaaccctacattcacagttagaaatttgcttgaatgaaaaagtgttcaaagtaattattatcttgtatttggcttctctgggtacctgtttggcttttatttctaaataaaaaaacaaaacatgcacaatgtaaatatttttagtttgtaaaattttctttccaattacatattttgagatgttgtatatactgtaaacattttgaagtaattttgcccaaattaagaaaaaaaattcattcatctttttatcttatttttattttggttcacttttcatctgggtattaatatggatgttgcagaaagaatagctcctataaatgataggttgctgtatggatatgcaacaaaaccatctttattttacagaaaggtctcattactctaaaagaaggccagtgaagaaatttatattgaccttttggcatgacctttctaaaccaactgttccctagtacctaaactagtgagtttactgcatagagacacccaaaggagtaaaacatgaagtgggagactttggccctattagaaaccttagggccaggttctgttccttatcacctatgagatttcccttgttaatgatgctgagttgggcatatttattttttagccatttcatcaacaagttttgcttatgactaaggatgtcatttcttgttcccatcacatggtgttttaggacattcctgctgctttaacaaaatatcttacttagagtaattcataatttataaaaattccttatacattctttatagattctgacaattccataagtgtcatgaatttcagtagggaagtgacttttcaaagtgagctctggacaggtagccataagtaagactacggtggcacggatatgctgtgctttgatcagttgtgtggtatgcaatttttattataaatatcactgaactccatatgacaaaaattactcatcaacttttcttttttttttttgagacggagtctcgctctgttgcccaggctggagtgcagtggcgcgatctcggctcactgaaacctccgtctcccgggttcacgccattctcctgtctcagcctctccgagtagctgggactacaggtgcccgccaccacgcccggctaatttttttgtatttttagtagagacggggtttcaccgtgttagccaggatggtctcgatctcctgacctcgtgatctgcccgcctccgcctcccaaagtgctgggattaaattagatgtaaaatgttgttcaggtttattaaataaagaaagaaaaagattgttaactagatgtcttattttgtttttctctgacaacagctgtcttgtaaattggtatatttagatcatgcacatttaaagtaattattgggtggtaaaaaagttgggctggtatttattatgtttataactattttctattcatatcatttattctttgcctcccaacaatcactctttttcttatttctattgttttaattgacacttaaaataatcccattacatttcctctcctagcatgtcagttatactttagaacagttttagtgatttatgtgagtttgcaatacacatttttaactaatctcaatctacctttaaataagactttgaataactcaacacaaatatcactttacaagagtgttacagactcaatatttgtattcccctattcccccaaaatgtgtatgttgaaacctaatccctatggtaagagtatttggagatgggtctgtgggaagtgattaggtcatgagggcaaactgttatggatagaattagtgcctttacaaaagaaaccctagagagctaatttgctcttctgccgtgtgaaatcccagtgacccatcctctatgaacaagcccttgccagacacttaatatgcacatggcttgaccttggacttcccagtctcagaactgaaaactgcatttttgttgattataagccacctagtgtatggtatcctgttataaaagcctgagcaaactaagatacaagtaatcccaattcctaccattatttatgacactactgccatttaatgtattcatttatatactatattcattcaatacattgttacagttattccttttaaacaaaatattatcttttaggtcaattaagaataagaaaataaaacattttattttagtttcattcattccttctatgatattcttcctttctttatatagaccaatttctgacctataccctttttcttctccctaggaacttctttgaacattctttgcaaggcatgtctactgaccataaactttctcagtttttgtttgtctgagaaggtctttatttcttctacactattgcaggataattctattagatatagaaatgtaggccagatgcgatggctcacacctgtaatcccagcactttgggaggccgaggcgagcagatcacgaggtcaggagattgagaccatcctggctaatacagtgaaatcccgtctctactaaaaatgcaaaactaattagccaggtgtgatggcatgcacctgtagtcctagctactcgggaggctgaggcaggagaaattgcttgcccaggaggtgggggttgcagtgagccaagattacaccactgcactccagtctccaaaaaaaaaaaaaaagaaaagaaatgtagatggtgtgtgtgtctctgtgtgtttcactttcaacactttaagtatttccccccactctcttcttcctttcatctaatgaaaaaccaactgtaattcttagccttatttatttacaggtaagttttcttgtttacccttggctcctttcagtatgtctctctgtctttgattttctttggtttaaaaaatatatacctaagtatagatttttgacatttattctgcttggtattctctgcacttcttgaatctgtattcagtatctgctgttaattttggaaaattcttagccattattactttaaatatttatttggatctgttcttcctttctttacattctggtattcagatgtacctgctaatagtctactagaaagaaaataaaatataaaattgagtaaaataaaacaaaataaaataaggagtagcaacacaatgcattaaattcaatgcaacggattaaatatgttttgatctgttaaaaaaatcaatctgaacaatgatgtggtttacagttagtatgcaatatagaactctgaatttaattgtttttatttttctacagtggttttacagtaaaaataatttgagtttaagtttggattgttacttttaaaaacagagctaattagcattgtttattactttctcaccttaattttcttatatatatatgtgtgtgtgtgtgtgtgtgtgtgtgtgtgtgtgtatatatatatatatatatatatatatataaagagattatagatctgtaatgcttagcataagtcctggtaaattgcatctattcaatgaacatttgttctccctttaattcctgcaatctagatggtggttcatggatatagttgctctctaattttttgagcatattaaggacttaaaagctaatgatggtgtattgttatgtcaaggccagcagagcatatcactttaaaaaactggcaatagaaacttctctttaaaaattgtaaaagtaagtaaagtttagaaaccaaccaagtacgagcaatgcaatgttagcatctcattggttcacaccagtgaaaagtatttaagaacaaagaaatggtatactgtaccacacagaaacttgcatgcaaatgtttattgcatgtgcagctatattcttacttactaaaacttagaagcacccagcttatcctttaataggtaatcattccttaattagataaacaaactctgctatatccatacaatgacataattatcaggggtaaaaaaataagccatccagtcatgattagacatggaggaaatttgaatgcatatttctatgtgaaagaagccagtctgaaaagtctacatattgtatgagtccaagtatataatcttctagaaaaggcgaaactatagagctagtgcaaagtttagtcattaccaggagttgggcatgtgggggataagtaggtggagcacagggaatttttagggcagtgaaattattatctatgattctgtaatggtggatacatgacatcatgcatttagcaaaacccatggaactgtataatacaaagagtgaaccctaatgtaaactctggtctttagtcaataaatgcatcaatgttggcttcttaatgcaatttcattttaaaatataaattttcttattttttccacatatttcttaggggaaaattttaaataatttctagcttcactgttttctaatggataaaagcataaattaaatatgcttttattactgagaggatatgacattgtagtaacagatttattaataatcaagaatgtattaacatatttatataaggtaacattctgtggatttttgtttccaaataactcagaattgacaaaataaaaatataattattcaatgatgaatatcacaatgagcaatattgatctatttcataaacatttcatcctgtcaatcacagggatactcagttcaaatacatcaaaagaaaacattcttcaggtaaattgaaattacaatagtttcaatttttacaaaagtttagatgttgataacagtttcagagccacttctctgtatagaaaagctttctggggatgtcatggttgtaactaaaaacaaaaatacagatttatagataacaaaatgaagagaaatctgttataaatattgattgtatgattatgaggtctttagaaattacaaattattttatcagtatattttaagtgtaggatatacttaatttgaatactaatatttattacatatgagcttaattgtgtctgttcaaaagatacaatgaagtgctaaactccagtaccttaaaatgtgaacttatttgataatagagctattgcagatgtcactagttaagatgaggtcaggtgagtgctgtccttataagaattgggcacagagatacatacatatagggagaatgtcctgtgatgacagagtcacaaactgatgcagttgcatgccaaaaaatgtgccaagaattgataactggcacctgaagacaagaggtaaagaaagattctctccttcaggtttcagagggagcatggtattgctaacatcttgattttgaatttctgacctccaaaactgagagaataagcttttgatgttttaagctacccagtttgtggtattttgtatgacagtcctaaaaaatgaatacaaatagtaaaccataagcaaaactacaagcatggaaatttaccctaattcactttctgcgtaacacttatgattcaaaaattgatattatattttgtatttttaattatctttctcacgtaggagaacataaacatcctgagggcaaaatctttattcagtttttattttactcataacacttagaacatcgagtggcaattgatgtgtttgctagtcaggatgttattctggtgaatactgttcattctatgtaacaagaaaccactgatgtatcagtagtttatgaaaggtttagtttaactgatgctacctatccaaaacaggcaaagcagtgggacttccccttcctgcgagtcaggtaaaatatttgatacatgttttcatagccacagagatggggggaaacagaacatggcaaagaatgactggactctaaaaagttttatattctggattagtcagaatttcaacagaaaacagttggtaaatacaactaagaataatttgaggaatgcttccatacaaaggaaggagcatgaaagaattgtaagcaataaatctggaactggcgctcagtgaggataaaaacaaaacatggaaaaagaaggagtagaagatcagaccacctggagaacaaaagtgaccttctgtaaagagacacatgtagggaagacagcctcatggggaagagaccaacagaataaacaccatgacccttttctcctcttcctttctgccttcttacagggttctccacaggctgaacctaacctgaagccagaggatgagggagcctcctaatgtattcgtgagaagtcaaaaaaaaaaaaaggccaatgagtcaggaagagtggaaagggttgcattagaagatattttacacattactttcctttttttatgttaccattataaagtgatatatctagaagcaatcttgcacatcaatctttatctacatctcagattgtgtaaactttatagcttactgtttccctcatgaaaagtaaagtatcccattgtaagagtaagacaatatacaactatgttatatagtgttaacttctgttaattgtttgtaagacaaattattggggtgattacatgaaataaggaggtctaaattaaactttcaatgacagaaaaccagcaatatataagaaacagaacaaacattcttaatgtatttaatgtatttcaatctgtgtatttagcatctacttataattttttaaacaatttaactctagtttttaatatagagaccattacaccatttcttcttatatttttaaattacattttatatcatctttatcattaggataagcaggggagaaatgttgaatatattgattgatgtatctgatatatacactcatgtgccacataattatgttttggtcaatgacagaccatatatgtatgatgttgacctcataagattctaatggccctgaaaaatttctatcatccagtgatattgtaagccacctaacattgtagcaaaatgtattgctactgtttgtggtgatgatggtgtaaacaaatttgctcttctttcagtgatactaaagtacacatacaattgtgtgcagtacatagtattagataatgataaactctgttactggtttatttgttttatatactacaatttttatcattagaattaccccttctacttatggaaaaacagttaaatctgtacaatagcctcaagcaaatctttcaggaagtattacagaaagaagcatcattaccataggaaataacaactccatgagtgtaattatctctgaagccttttcagtgggacaagatgtggaggttcagacagtaatattgattatcctgacctcatgttgacatagtctaatgtgtttgtttgtcttttttttgttttttgtttatttttacaagaaaggtttacaacataaaagaaaaaaaaaaaagaaataccgaagtggttccccaaggcaccaatttaaagtgtatatgtgcagtgcagggttactggaccaaggcacagtgtaaacagcgaaattttattttttgttttctttttcctaagatgttccttactcccagttacataaaaatgtgtattacaagcaaacaaaaattaacaggaatagaaataactataaagtatattcacattaaaatcagctttgctttatctattaaaggatgtaacacagttgtggttttcaggaccttgtaactcctggtgaattggaaagcacagaaattcttcagagcctcaagagttgtgtttaatgcattatttaaatagtgtccaaccactagttagatagcttaacactcaaatagcttttgaaatctctgtagactcacctcaattgaagagtcctgataatttacagaagtgtgtagtgcactaagagatccctgctgtacgatgcctgcctgtggagtgttttatgtgttgatccactggagtgtgtgtgtgtgtctgtgtgtacgtgggtgagtatgggtgggtgtggattgtgtgtatgtgtatgtatttacattgtggtatgtgtctgttggggtgccgccattagggatttggaagagtgaggaccataaacttgtcaacattcctacatgcctgcttcataacaagtgtactgaacatggccaaaataactaaaccaagtaaacaaattagacattaattaaatttaatgctgggcaggaaagaagtagtcaaggccaggtaaaatgaagaaatataaccaagtgaatgaaatttttacattgattcgtagaatgagacatgaatattttttaaaatttgtaatttctaatgactatcagtatataaaactaagaattatatggctgtcaactgactaaaaactgtacataagattagagctagtgaaacaaccatatatgaacttctatttccacttttctgtctcaagaatgacttgtgaaaatgatgttttttttgaaattttacattctcattttgaaagagcttcacaaaacttacgtgagaatctggatgctcataagaggtctgattttttaatggcatgtttgtatttctgttatgtacatcaatgtcaagcattcgtttcctgagctgttctctacaacacaatttaacttgtaatagacactcaataaaaggtcggttggatattcaaatcaacaccttagttccatcaattttcatttcatataaaaatgcctgatcttctatactcaccaatgaaacagagagagatgaaggagggagagcagttgagactgagaggatgacgagcagacctcattctgcagtggatttcctacactctccacttctgaatgcttggaaacacttgccatgcttagaaaatattggtatttcctaggcagcaaatgggagttaaagaaagtccatatttctatattacaataacttacactataatacacagacaacatacatttctaagctatttcaattcatagaaaatgtagataaatttaggtgagcaaggtgtaggagaagggttagtaatcaagctgagtgtgattgtgagattaaatctaatattatgcaattattgtataattgtatcagttgacatatctgttgaaacagaaggtgggagagttttgcatgcgcttccgaaatgtactggatgatgttaggagagaggcgggtcaacgtggctaggccataagtgtttactaattgaggcttaggaaagttaagttcctaaccagagactgggagatagaggcgctaaattgtataacatttatatttaatatatatttaataatatatagtaaagtcttaaaatgccaattttaagtcttttcattttcttcttaaaaacagaggttttattgcgtttggtccacagtcggtatttcacattatctcatagcgcagggcccctgggtggagggctctgtgcagtacttggcgtggcctggggccgggagagatagagcagtagacctggtcaggcccggaaggggagaaggagggccggggctccttaagacctactgagggcctgggcgcggtggctctcgcctgtcatcccaacactttgggaggacgaaacaggcggatcacatgagggaaagagttccaaaccagcctggccaacatggtgaaatcccgtctctactaaaaatacaaaaaatttaggcaggcgtggtggtgggcgcctgtagtcccagctactctggaggctgaggcaggagaatcgcttgagcccggtaggccgaggtgcagtgaggcgagattactccagtgcgcttcagcctgggcaacagagtgagactacatctcaaaaaaacaaaaacaaacaaaaagccctactgagggccacggaggtgggggagcaggatggagatgggtcaggcttaaccctgacaactcaaaattccactaccttgtacgggcctcagtttcctcaaggagccccagcgtaggtctgaggtctgttggtctgagggtcctagggaaatccagccgctcaggagcctgagatattttagcatcgtggctgagccccctctcccaggggacacacttcctagcaccctctccactgtccccgccccattcctcggggaaaaaaaattttttttattttgttaatacttcctgaaacttttgcgggtacagaaaccacttactgataggctgagaaaaggggaagaggagaggcaaccagaaaccttcagggaccggttccctccatgtccaggtctcttctctccagcacagctcagcctacagcctggaagtgccagcgggcaccttcaccctacacgcatcaggatatggccttgatcccttcccccacagcccggtggctcagtcctgagaaggaaccaaagcagggggaggtggggaaaaatccctgctgcctgatcccacgctgccactcacagaccctcggttgactggcagcactgaacaggtttaaaaaaaaaaagatgaaaacacagaaaaacccaaacacccagaggggagatcatgtgtggagagagcgtgctgggagcctcagtagccggtctcctcctggtagtaagggagatattcaggggccggagcccgagggagcgccgtgggccactgggcctccccagtagtacctggggtcgtatatctgtaggcccatgccgaaggcctggccgctctgatgagcgccctgcgtgtatcccatcttcagggacgtggaggagttgtcacacttgtcgattcccagcttggtgtcataggtgtgctcattactcctatctagctgtaagtttgtatttgttaaccaacctctccctgtcctcttctccctgttgctctccccagcctgtaataaccagaattctactctccacttccatgagctcagttcgtttttttttagctcccacatatgagtgagaacatgcaagatttataattctgtgcctaggttatttcacttaatgtagtgttccaggctgatccatgttgcagccaaggacaggatttcattatttttacggctaaatagtactccactgtgaatagatactacatttttaatctattatgtttttggacatttaggttgattctaatcttggctactgtgaatagtggctgctataaacatgagggtgcaggtatctcctaaatatgctgatttcctttcctgtagataaatgccccatagtgggactgctggaaaaagaaaaaattctttttctttaaacctgatcatgtctgtcctcataaatgcatgttacacccatctctcgccatcaatgcaacccgaccccgagcagttgttcactcttctcttccctcgttctcggcacaccgtgtgcctccataccccagcctcaggcctttctataccacttcccatttgaggcactgtgtttttattcaactttggtactgtcctttgagaatcttcaacgtgatttggatatggcactttttatcaggatgttacgtcagtgttgataaattcaaagtaatatcgttctttttcctgccaaagtcagctcctcctttccactgcactttcctgccgatgccaccactctttctcctgaatgttctcagaggacacccttgtacctggactggtcattacataggtgtaagttttattctctaaaaggggtgagtgagagtttatactaaggttgtaagcatccctcagggcagactctggatgtatattacagaactgctgaacttgtggaatgtgcatgtttaatactgaaaatatttaatgccacatgtgtaagacttttgccaactggaatctgaacatcaacaactttgaagggcttattctaccttctcggcacaaaaatagtttctacgaatgcacatatttatgtgcaaacgtatagaaaattgactttaaagtgtacaacaaatttattttagcaattgggcctgggggacctagaaggagaatgagattggagtggtaggggtggaacattagctaataatgatttattttattaaaagtaattactgaaaaccaatgcaataaaatattaacatgttacttgaaggggttgggagtatagtgcttatattcttctttacatgttttaatatctttaaaattccttgttttgcttttgctaaggaagtcacagtttaattggcagtatatctctaatggtacatgaaataatgtctgatttctaaacattgacattctacattagatgaaatatattaactattaagctttgatattacactataaaattaattgaagaaagccacccctctttgtttctttcttttttagttattatgtgccccatgtgatctgcaggagttttttttctaggctttgaacattttaaataaaatcagaatttgttcaagttcagttaacactcagctgtgaaccctatggtactggggtctttttcaatgggagatctctaagcattattccaaactattctatgctaattgatctattgataatttataatttattatgaaatacattaaatttcttaaaaagaaaaaggaaagaagtaaagggaaacatttattacaatttaaataaaggaattagcagttgaaaacaagaaaacctattctgagcatccatacttctcggcaaccaaaacaatcaatgaaatcaatgcattgggttaaacagttcccaattgcccactatgttaccaggagaaaaaaaccctttatcatagggttaaactttgggaaggattttccataaggatcttaatataaaggttcttgaatggcataatgtataaggtctttgatagcaacgctacccacagtgcaaagatgttttactagtcctgttggtgtctcaaattggctcttggtaagtaatctggacatatcgtgaaattataattctgtgtagacaattcgacttaccaggttagagtgatgcaatccaaatagatggctttcttctgatctggcttaacagaaatcttgaaaaatctggaggagtaaatgtttaatataccctcagttctcaaccattcttcttcccctgaaagacaacatcacaggcaggacatcctcccaagtgtacacgcaatattatgtacagttcccacgtgagaaagcacatcataatcttagtgagaatgatgttctcataaggtcagttatactcagtgtgcatagttgtccaagtgtgagtatgaaaccaagtcattcgcaagtaccactagtctgattattagtaataataatccacttgtgacatagtttttctttgctgaaataaaatattgttttgacaccatggttgaaatgttggtcttaggtcaatgctctctattatctgttgttgttgccaagcctctgagaggtgttttatgtggggcaaaaggtcccttcctgtgtctttggtcaaagcaaaggaggagtacagacgactgagagagtgatcacgctgctgtgcccacctatgcggtagaccttgttcctgggttgggagatgttttatgatcagggtgcagtagaaggagcacactagtagcagtaaagagaggtgaccctggctgcagttctgcctctaacttcctgagtgacctcaggctagtcacacagtgactgctccccacatttctttttgtaagctgcaaggattgaatcagacaatagcctctaagtttcttctgaactctcatactcagggatgccaacgatgttggtaataaaatagtatgaacatgccaaaaaaataaaaataaggaagagaaataggtatgtaactttactctgggactcctgtggtatctcacaacaccatgcttcatgaaccccaaagaaagcaaaaaatccagctagtgttataaatcctgatcagctgaattctttcacatgttgcagcctgactcaagttattcatcgcagaggctagcagctccctgatgcatccttccttgtctctggacagggtaaaaataagaaattggccattgtgagacactctgagtttcgtgggattgagcagagcatattttatattcttctcttggaactgcctcttgttggtagtaaatggttgccagcactgttgtttctcaatagacaagtcctagaaataaagataattcaattttcattcactcttagctcttctgctaccagtgttcttctttgacactgacagggctgcacctgtctccctggcctgacatagcacttgtatggtttgccacttgccagaaaatccacgagtcattctaaagaccttttgcccagcagagaccactccagtgagcacaaattgtctagtggttttttttagatggtcttcctccttggctcatttctctccaagaacgaaaatatcaaggtgttcatttaacagcagctcctgaaagacaatccagcttgatttaaatctttaacggttttcattataatagaaaatataatagcaacagtagcatcctcttttacattgaaattaaattgcaattctttcactgttggggtggcaagtataattcctatcacttctttggaaagcaatacaacttactaaagatcaccaaaatgtttatactttttggaaccaaaaacctcactgaaaaaagtttattccaagagtatgattcaacagaaaaaaaaaagtaatatacatgtgcatgtttctccctgtgaaaacaacagcacagaatttactagacaagttttgaaacagttggctatgtggtaacatggaacaacattctcctataatgttgaaggataaaagcttagagaatagaatatattctatgactgcaactgtgaaagaaaacatagatctacatagggacaaagatgataaacatgcgaaaacaggtgttagattcatggattatgtgtatttttcctgcattcaaatttatctttattattgcttttttatgttcccctctcctccccccaaaaaatcctaaagatcttgaatatgcccctgtcaatatttaacatttcttctgaaactgagtctagatactcaatctgctccagttttttgaacaagatgagtagcaaggttattctttccatttttttgtttgtttgtgttttttgtttgttttttgtttttttttttacagccagacacaggtcttgaattgtacagctgactgctttgtttgggatacgttactttcaatcattttcctgatcctctgcatgatttacagaagccgagtgggtggctttagcatttccatggtcctccctctccactatcatgacattcttaggtgaattttttttagagccattattctccatttacaaaggcagaatgcagtggcaggagctgggactctgggaaaccaacagccaagaattcaaactacagcatactatgaaacactcagataagatgtccccatcatattctattattgggcaaaataaaaggtaaaccatgtgctcaaaacagcaaatattgtgggtgacagtgacactggtattcggaaagatgaagagatgcaattaagaaacctggcaaagaagtaaacatgccatgtagcttacaaaagaccagccacattgtgtgtattttaatattgtttaacagtaacacctaataaagagagcatcatgattgtgtgaactacattttcggtcataatgaatgctacaaaattaacctcccaagtttagacaggctacaacgtcttgggaaatatgcaagaagaattatttgataaaggtgacagtttttcacacctgaaaatgatcttctcccagcctatcttgatcaacagccagcagcaacacattgcagatataatctcaagaccttgtggcatgtacttctcactacatgcataacttactatggacagaggatcatggagattttgaatataatttcccacatgacaggagattaaatagaccacattggaagaagctaggtctctggagaaccaaaaagtaaacttcagccagttctggaggcagataaacagcaggaaatgtactttcagatgggctactttctcaatagttctttcttgcaagagctctagggaaagtatgagttactgggtaagaatgtaatagaaaaggggccagccttggaaaactttgcaatggaagaaaatcagtgtctcctcatttacatctttctttctcctcttcctttgtaatgccacctttcttgggatattccttcccctagaataccctgcctgtcaccccacgagaacctgctcttgagactgcatttctaatacctataatgagatgttatgtcaatgccttatctctcagtgtgtgtatatacatattaagctttctgtctatgttgtgctttctcatgcaggaatatcagacattaatgaaccagtaaagaagatactgaggtgcagaagagctttcccagtgtcccgggagccattctacacagcatcctacagaatgactgtggatctgctgtgcttagtttctttacttgtgaaaacagagtaatagcagcacctacctcacagggttgttctgaagattagaggggttctttcatgggaagctctagagcagtgcttgagacatggtaagtgctcaacatgtgttcattattattatcattatcaatatttgatgtaaaagcctttctgaaagaaatcacacaagaacatgatcagttaaaagatatatatgaatgaaagtatgtttggcgctgtcacaacacagagtgacataatggttaggaacataggctttggaagtcaaccatctgtgctcaaagcctagtgtcaccacacagccattgtgggacactgggcctcagatttctagcctgaaaaatgggggaacaatgtctgtcatataaagttgctgtaaagatcaaactggataagaaatgtaaaatactcaacagtgcctgacacaaaataaacaccaattaatggtagcaggaagaaaagagcactcttcaccaacattttaccttcagaaattggttaagaagaaatgagtgcttaggaaccttcctgttagagctgggaacacaaataaccccaagatatgacccaactgagaaaagagatacgagagtcagcaggtctcaggactcgagaacatatcatagatctggggccaaggggacctcccaatacctcagtcttgaattagccagatgtgcctttcagtccttggctgagctggactgaggcctcctccaaagggagaaataaatgcgcatcctgaagagagctgactctgaaagagagagaaacccacagaggctgagtttcaccagtacagctactttcaagcacattcctcagttaagtcatttctcttcccaaggggaggactgaatgagcttatggtgagaggccaaaagcttttctcctttgtttttccctcatgggagaggacggaagtgctatcctttctgtgggaacctgcagactatggacgtttcccccagcagttggcattgactgatttatctgcatgtttctctgttcacatcctctatatgaagaatcgaagtgggaatagcccccaagtaatctgatagtaccaaagcactattctagttttgtataatttttaagtctcttctttaaatttttttttgcagactccatcccagacacagcataccagagtctccaaagggctaagctcagcaatctgttctcaagctcccaacaggagtcttatatagtcaggcaggcaatgatcatatatggggaccattagaaataatctaatgcataccctctgaacttcaaatttttagtattctcattttctgctcaagctcaatttcaacacagttcacagtttctcatatccaccatggcattctgccaaggaactacaactcgtgttctctaaacccatctgttctaagaatgctgggctggttatcaatttctaatgtacctgcttaaactttcctctctcaatatgtccctgactgaactgcagaagacagaacaactgtactagccatctctttctgcatatcccatgtccccacagaggccactgtgtcttcataaagctaactgccacgattttcacaagtgatatttttccttcatgattttccattttctacttgggcattaaaataccagggagaaaaggaagataatcgtttagcagctgggaaaataagatatgtgccccagcacagtacatgctaagtattcagaatgtatagttatagtagataactataaattagataactattaaaatagttatattagataagcaatatttttctcatcttcaagacttaaaaagttaactgttttaagtggtattcaaaaaaggaaggtactcactcacatcaaccctattgaaaccacatttctatagctggatgtaacaatcttaatccaaatcattcaccaaagttgtttaactttcttaaagtaaggctctagacatttgcttctttacaagtatcttgcaaagccattatgaggtagaagaaatgtttaaatgcgccacattttcctactgcattgtaactaaaattactactcacaggacgtgtatagcttctgcattttggtccatcacattttccgccatcaaatgagtgtattcttaaggttctcactttatcatcagcataacatattttgcttccagaatgcccagtaaggctgaaatttttcatttaaagtgataaaaaagttccccaaatatctacttaacaatcttagatctgagttttagcaagacagtttaatgcatacacaatgaaaacactatatttctcactctctctcacatgcacagattaaaaccccaaagttttcactatatttcctctttcttatacagctcaatttttaacatgcagcttccttataatctaaaaacaattttaaatatgattatcataaaaatattttaaaacagagatgaaatgtgtaaaggcagatatagatcatccatggttacattggttacatcacatttctttagaaacagaactgtttctactcctgtagacaaacttctctctcacacatttaaagtgaggttagtgctgacataaaattatcgctctactcaccatctgagtgtttgcactgtgtttgaggtacattttcttcattttcacagccccaccactcttgagagtatgagtcaacagaagtttgcaggctaaaaccattcaataatattttcatcaatactggaatgatagtaagtaacattacacaacatcagaggccaaaaatttttctttgttgaagcccaagattttaacttattcttcattacctgaaaatactgctcatttaacctcttcaggaaaaaaaaaattctgtagatgaataattcctgccttaatgcttcacccaagacagttccttcatacttatcctccaatgctttgttcttttcatccatttgatgtagcaggcaacaagaatcacctttcctttggtgatctgacatagcgatctcttatgtttttgctaattgtttgataaatatttagtaaatttttccacgatatgtatgcactattttttgtagttccaattctaaaggttttattaatgaatgaacattgtcatcttaaaagaacaatttctcagtgcttcataaacagctctaaatgctggttgcttatcatcatggtaaacacctctgttcccgtgaaaaataaagattccttcttctgcttcttggcaactgcttccatatagacagtgatctggacgacacttccattgacacggaaagacaaaaaggctttctggattatgaaaaaacaggatatccaacagatcttgatcgcccatgtaatgtttaacttgtatattttaagccatgtcataagtatatctcctcattgtagtcacacagttgtcatattattcttgaaatacttccttctcattcaagtcatgtttgtcaacataactccagagtttactccagcttttccacactatggatgcctagcacagcgactataccatcctatttgacattccttgtgttctggggccattgcagaatttgtgtggaattaaatttctttagtaaagaccaaatattatcagctggtcttttaaaaaggctatcagtgtgagagtcaacttctttcaggaataacggcaaggacaatctctgcaaaccacatggtttaaagagtttttccactctgctgcattctcacttggaaaggttatggagtatattgtataattaaatatttgtagaaatgacccctgtcaagccttcctttaaagctatgatgtagttgatcttcagcaaaaatctggaattgaagaggtttgatcctgaaaataatagctgacttcaacatggtcatagtttcttccagtctttcacctagatacattttctcaacaggctgtattttcagactacacctgtcccacctgcggggatgagcagcgggacaagcgctgctcgcgcctctcaccgcaccgcatccgcctcccgccagccaggaagccactgcggcctgcggcttcccgccaccacggcccgctccttcctccggggacacggggagctggctgaaggcgtaaaggagcgagcagaagcctcaggccagacacagagccaccacgcgcggtagcgccgcatggccccagcggcgttcctcggtctccgtctccgccgcgcccgcctgacgaactggagcacagggaccatagttctggaaatttatcctttttctctccatggattcagcagcagcgtctaaaagaaaaaaaatcatcaatcaatcatttatatatgttttaatataaagatataaaacagtggaaccagtggaactggatagaaagtaattcagttttacagaacacatctgtttttcaggctcttacttttcttaaacataaaagagccatatatatttctatggaattccccttttacttaagaattcattatcagcgaattagtgtaacgaggctgttttgttagaggctgtggttgcattcaaaaattagaataggaacaacgacttgtaaaaattcaacactttattttatttttgagacagtttcactgtgttgtccaggctggagtgcagtggcttgatctcagctcactgcaacctccccctccagggttcaagccattctcctgcctcagcctcccgagtagctgggattacagatttgtgccaccatacctggctaatttttgtatttttagtagagaaggggtttcaccatgttggccaggctggtcttgaactgccaacctcaggcgatcctcccccctcagcctcccaaagtgctgggagtacaggcgtgatttaacattttaacattttaaactaccacttactacattcactgtgtctgtgatttaatatacctttttcagtggccacaaaattataaaatggatacagaatagtctcttcaaaacattaaggaagttctttcttttttctttttctttttctttttttttttttttggtttgagacggagtcttgctctgtcgcccaggctagagtgcagtggcacaatcttggctcactgcaacctccgcctcccgggtttaaggaattctcttcttcagcctcccgagtagctgggattacaggcgcccgccaccacgcccagctaatttttttgtatttttagtagagacgaagtttcaccatcttggccagactggtcttgaattcctgacctcatgatcagcccgcctcggcctcccaaagtgctgggattacaggcgtgagccacagcgccccgccgcaagttctttcttcttgaaaggattataaatataattcatactggcatgacacttttactaatatagattgacttttcgcttcaaataacccattcgtatatcgaaattaattttggtcagtatgtgtgtgtgtggatgtatgtgtgtgtggatgtgtggatgtatgtgtgtgtggatgtgtggatgtaaatggcagtaaagggtaaaagggaaggtggaaaaaagggagatggtctaacattttccacacatttttaaatacacaaaatgtatatttaacacaatacacatacaataaaatatgtagtaaaacaatggtgtggtgaaaacaaaacattgcgaactagaaaaaagacttagccgctggtcctgtcggatccgccccgcggcggcgccctccagccataagctccacgcagttcaacaagggcccctcctacaggctcttggcggacgtccagaacaggcttctgcccaaatatgactcccagaaggaggcagagctccgcagctggatcaagggattcactggcctctccatccgccccgacttccagaagggcctgaaggacgggattattttatgcacactcgtgaacaaactgcagccgggctcagtccccaagatcaacggcttccgtgtagaactggcactagctagaaaacctctccaacttcctcaaggcaatggtcagctacggcatgatcccgtggacctatttgaggccaacgacctgtttgagagtgggaacaatatgcaggtgcgggtgtctcttctcgccctggcagggaaggccaagactaaggggctgcggagcggggtggacatccgtgacaagtactcagagaagcagaacttcgacgacaccaccatgaaggccagccagtgcgtcatccggctgcagattaccaacaaatgtgccagccagtcaggcatgaccgcatatggcacgaggaggcatctctacgaccccaagaaccgcatcctgccccccatggacaattcgaccatcagcctccagatgggtacaaacaagtgcgccagccaggtgggcatgacggctcccgggacccagcggcacatctatgacaccaagttgggaatcgacaagtgtgagaactcctccatgtccctgaagatgggctacacgcaggttgccaatcacagcggccaggtctttggcctaggccggcaaatatacgaacccaagtactagccaggtggcccagtggcccacggggctccctccgccggcaactgcccagggccaggggaggccccttactaccaggaggagaccggctactgaggctcccagcacgctctctccacacatggtctccccgtctgggtgttgggtttttctgtgttttcatcttttttttttttaacctgttcagtgctgccagtcaaccgagggtctgtgagtggcagcgtgggatcaggcagcagggttttttccccacctccccttgctttggttccttggcaggactgagacaccgggctgtgggggaagggatcaaggccgtatcctgatgcgtgtagggtgaaggtccccgctggcacttccaggctgtgggctgagctgtgctggggagaagagacctgggcatggagggaaccagtccccgaaggtttctggttgcctctcctcttcccctttttgtcagccgatcagtttgtggtttctgtacctgcaaaagtttcaggaagtattaacaaaagaaagaaaatttttttcttctccgaggaatggggcggagacagtggagagggtgctgggaaatgagtcccctgggagagggggcccagccatgatgctaaaatatctcaggctcctgagtggctggatttccctaggaccctcagaccgacagacctcagaccctcagacctatgctggggcccggtgaggaaactgagacccgtacaagttagtggaattctgagttgccaggattaagtctgacccctctccatcctagctcccccacccccgtggccctcagtagggttttttgtttgtttttgtttttgttttttttgagatgcagtctcactctgtcgcccaggctgaagcacagtggagtaatctcgcctcactgcacctcagcctcccagcttaagcgattctcctgcctcagcctccagagtagctgagactacaggcgcccaccaccacgcctacctaattttttgtatttttagtagagacgggatttcaccatgttggccaggctggtcgggaactctttccctcatgtgatccgcctgtttcgtcctcccaaagtgttgggatgacaggcgagagccaccgcgcccaggccctcagtaggtcttaaggagccccggccctccttctccccttccgggcctgaccaggtctactgctctatctctcccggctccaggccacgccaagtactgcacagagccctccacccaggcgccctgcgctatgagataatgtgaaataccgactgtggaccaaacgcaataaaacctctgttttttaagaagaaaatgaaaagacttaaaactggcattttaagactttattatgtattattaattatatattaaatataaatgttatacactttagcgcctctatctcccagtctctggttaggagcttaactttcctaagcctcaattagtaaacacttatggcctagccacgttgacccgcctctctcctaacatcatccagtacatttcggaagcgcatgcaaaactctcccaccttctgtttcaacagatatgtcaactgatacaattatacaataattgtataagataatattagatttaatctcacaatcacactcagcttgattactaacccttctcttacatcttgctcacctaaatttatctacattttctgtgaactgaaatagcttagaaatgtatgccatctgtgtattatagtgtaagttattgtaatatagaaatatggactttctttaactcccatttgctgcctaggaaataccaatattttttgagcatggcaagtgtttccaagcattcagaagtggagagtgtaggaaatccactgcagaatgaggtctgcttgtcatcctctcagtctcaactgctctccctccttcatctctctctgtttcattgatgagtatagaagatcaggcatttttatatgaagtgaaaattgatggaactaaggtgttgatttgaatatccaaccgaccatttactgagtgtccattacaagttaaattgtgttgtagagaacagctcaggaaacgaatgcttgacattgatgtacataacaaaaatacaaacataccattaaaaaatcagacctcttatgacaatccagattctcatgtaagttttgtgaagctctttcaagatgagaatgtaaaatttcaaaaaaaaaatcattttaacaagtcattcttgagatagaaaagtggaattagaagatcatatatggttgtttcactagctcaaatcttatgtacagtttttagtcaattgacagccatatgattcttattttatatgctgttattcattagaaactacaaattttaaaaaatattcctgtctcattctatgaatcaatctaaaaatttcattcatttggttatatttcttcattttacctggccttgaatacttctttcccgcccagcattaaatttaattaatgtctaatttgtttacttggtttagttacttttggccatgttcagtacacttcttatgaagcaggcatgtaggaatgttgacaagtttatggtcctcacttttccaaatcccaaatggtggcaccccaacagacacataccacagtgtaaacacatacacacacacacaatccacacccacccatactcacccacctacacacagacacacacacacacacacactccagtggatcaacacataaaacactccacaggcaaagacattatccatcagggatctcttagtgcactacacacttctgtaaattatcaggactcctcaattgaggtgagtctacagagatttcaaaggctatttgagtgctaagctatctaactagtggttggacactatttaaataatgtgttaaacacaactcttgaggctctgaagaatttctatgctttccaatgaaccaggagttacaaggtcctgaaaaccacaagtgtgttacatcctttaatagataaagcaaagctgatattaatgtgaatatactttatatttacttatattcgtgttaatttttctttgcctgtaatacatatttttatataatggggaataagaaacatcttaggaaaaagaaaacaaaaaataaaatttcactgtttacactgtgccttggtccagtaaccctgcactgcacatatacactttaaattggtgtcttggggaaccacctcggtatttcattttaatagcgcatcctggagaatatatttgagtggatcacatattacaactgatttaaattttgacccatatagaaatgttttcaaaaatatgtctgaagcctggatactgtaaaaatgtttatcatcatagaataataaaaggctagccattagttactcagaaattgttcagtaaatctaagatgacttagacataaatagttatgagtgaatatagttcatcattaatgtttgtaaaaattaatgctgtcttttatggttgagaaaaactagaaatgtaacttaatttgatagagataaatgacataaactttacataaagcaagagaataatagatgtgtaaaaatgttttgtagataagattttaagatgaaattgtgctgaacgacatgaatcaaatgtgttttgcatactacatctgcagctacaacatcacagccttttaagtatttcgttaacttcaaaatgtaacttattgctgaaacaatctgatttaatgaattgggataacgggtaatgattggtgtcagctgaaagcaatgctacaattttaaagttagatttctttgtgtattaatacaaacaccagagaagatggtcaataaagtaattactgtacaatgcctatcataatacttaaacctggaagaaaatcagaaaatgttaagtgaatagaattggtgaattgtttccattttatacaattttttgttcattttagggcttaccaaaacttgcagctctgaataaggcccaattatttactccttcaaataaaacaagactgcaagaataagagtgaatgctttgttttgttttgtttttcactgaaatattccagtctgtagcagctccaaatcacactgatctttctagagtctgatacaggtcctggtctcaaggccagtgttaccataatcaccatcttttgtgcttcaaggttgagccctcctaatttacctgcatgaaattggaaaagtcctgtttcatactttaagcaacctagatgtctctttcactaaaagtggtattcttcttgtgtgttttttttttttttttttgcagcaaatgatgtcaacttctacctacacctgacatctcaattaatttttgacattttcttcttcacatttccatttcaaatcaccaagtattgtcagattttaccttctctctatttcttgaatgaatttttctctttctatcttcattgccatcatggattccagcccatcactctctcacctgggctatggtgcacacctctaaagtgctctccctgattctctctccaaaaatggttctgtgctatatctggaatgattacttgaaatgtaaatacaatttgcattgtaaattgctttgcttaaaaactcccaaagacttcacattagtactaggataaatagcaagagtccaaaaatgggttcaagcagtacaaaatttgtttcctttctctttcccccctcttgtggcatgaacattgttgaactaaatgattcagatgtatttcttcttgtctcctggactttggtcttcttactcatatgcttttcccactaccatcccagatttatataattagctcttactgggtttttttgtttgttttttttgagatggagtcttgctctgttgcccaggctggagtgcagtggtgtgatctcagctcactacaagctccacctcccaggttcatgccattctcctgccttagcctccagagtagctgggactacaggcgcctgccacctcacctggctaattttttttttttttttttgtatttttagtagagacagggtttcacagtgttagccaggatggtctcgatctcctgacctcgtgattcacctgcctcagcctcccaaagtgctgggattacaggtgtaagccaccacacccagccagctcttactcttattttagtttgctcttcatcttccccaccaagggaaaccttacctgatatccctaaatatgaaaggctttcataacagtgcatagcttttctctgttatttataatattgtttttaggtttttatatttttattactatttataatagatacatctgagcatgctctttgataataagtctaataaagttttgatgcatttagtaattcagtacaaaattgttttctataagccatgattctagagattgaggggaaagtgcagtggtaatctgtcccaaatggaaggacaaatagccaagcaatgttgacctacccattcatctctcaaaaacagagttaagatattgattctcctgttttcaggatgaagcagggacagggagtttcttgttatcctctcaactcactctttttatggaaaaagtaattaatctgataaatgacacaaaagattttgatgttcattaacaaggtggtgattccaagaagttgaaataaaaagacttcagagcccgtctctctcaatcactatctttggtctcttgaggatgcttgtgcacaaaatagggagcacccatgtaagagctgcataggcaggctcagtccagcaactggtttcataaatccaacttttccaagcatgatggaatgtcagaatcccgtgagccaaaagttttatgatgagagaggaagaatgatatttactccccaatctaatttttaaattaaattttaaacaaagttaataaagttaacaaacctgaatacacacacacacatgcatatatacccacgcacatgcacacaggcttcttgcattcttttttttgtttaatcattcatgagaaatggttggattttgtattttctatctaccaatacttgcacaaactctggctgcaaaacttttgttggtcaaatattagcatttgggaaaccacatccctgctgagagatagaagatcttgatacaaccttaactacatcatcagtagacatgggactgtttttaaccagaaggaggcaaatgtcttccagatggttgtgtagctggttttaacagtagcctgcagtggctttttgacagacataaaccttactagttattattaggcttcagagcattagtatgaagttttaatttggcttatgttagggatgagaaggtagcactatcctagatgccctaaatattgctccttgtcactttttccccactgaattcagaggtaatctggggactgtgtctaaaatggccttatattcatgtgtttgccatgggtttctgaagctttcattctgaacatggtctcaagttggctcttgagggctaatttcattacacatgatcataggcataaatttaaatttgtggaggattgttttgtacatcccacatgaaggggtgacctgcccctccacacctgtgggtgtttctcattgggtgggatgagagactgagaaaagaaagagacacagagacaaagtatagagaaagaaacatgggcccagggtaccggcactcagcatatggaggatccacgctggcaccagtctctgagttccctcagtatttattgatcattatctctaccatctcagagagggggatgtggcagggcaatagggtaatagtggggagagggtcagcaggaaaacatgtgaacaaatgtctgtgtgccataaacaaggttagaaaaggtgctgtgctttgaggtgcacatacataaacatctcggtgcattaaagggcagtattgcagccagcatgtctcacctccagccttaaggcagttttctccttatctcagttgatggaacatacaatccggttttacaccgagacattccattgcccagggacgagcaggagacagatgccttcctcttatctcaactgcaaagaggccttcctcttttactaatcctcctcagcacagaccctttatgggtgtctggctgggggatggtcaggtctttcccttcccacaaggccatatctcagactatcacttggggagaaaccttggacaatacctggctttcctaggcagaggtccctgcagccttccgtagtgtgtagtgtattgtgtccctgggtacttgagattagagagtggtgatgacttttaacaagcaaactgccttcaagcacttgtttaacaaagcacatcctgcatagccctaaatccattaaaccttgagtcaacacagtgcatgtctctgccagcacagggttgggggtagggttacagattaacagcatctcaaggcagaagaatttttcttagtacagaacaaaatggagtctcttatgtctacttctttctacatagacacagtaacagtctgatctctctttcttttccccacaccacagaatctggattcactaccaagagactgtagcatttatcaaaaagaagataaagagaaataagagttcttgttgtctagggaatatatcatcttctttaggtaatgcttattaatgctcctcaaaatagctagagcattcaagctttgtaccgagttcacaatgagagaagtagcttctactagaaattaaatatgttacttctttcattgagtaactattgctacaagaatacgtttgctgaataaattagcacatttattgatataattgatttgcatactgtggcagcacttcatggaccaaaccctaagtcccatgaaaaattgaatagaattatttgacagttaagtatcattggaaaagcctggctctagttctcaggaagcaatctggttgattatgtgttttcggtgtgtagtcataatacaactgtatatcactagtgtacattagacactttgtgcactctacatatattttctcatttgatccttcaatacatgcataacagaagaaatagacgtggatttaattgctccactagggtcaaagaccaaaaacctcattacaatgccaatgttagaaattcttcttccaattaaaataaagttaccaaagacaattgctcctgccataatgagaaaatatcggatgaactttaaaaaattattttttttttgtttaaagccatcaaaaaattgtgggtctaaagtgtcaatgaactaaatttcagagaaaaacaagcccttccttggtgatcacagattagcagcagagcccatctctgaggacatttgctggatctggggccttgagtaggtagaagaacaagcctacaatgtgcagacagctggaacattgggaataagcaaaataatctacagggaactgcaagagggactgaaaactagaaagatcacgtgttctcctcgcacttacttatttccacttaagagacagggtctcattctgtcacccaggctatggtgcagtggaataatcattgctcactgcagcctcaaactcctccctcaggtgatcctcctgcttcagcctctccagtacatggaactacaggtgcatgacatcatgcttggctaatttttaatttttttgtgtgtggacacaaaaaccgactaggtttcccaggctggtctagaactcttggcctcaagtgttcttcctgccttgacccccaccctctccaaccaagcactgggattacaggtgtaatgacagggagtcatcacatctggcctcccctagcatttagatattaaactgttggaaaaatgagtaaaaaataaatgtaagtagcattttgagtattttcttcccatacacccatggattgtttagtgtatcttactacttcacataggagaccattcctgcatcaaactatataaactaagtatttaaatttgattttttccctacaataagctctatgctaaagctcattacatttgattttgacaatctgtttttataccacagttgcaaaaaattaatcacattctttacttcatgagacattatcattattgtttcctacaagtttctctggttttacttgtttcatttttttattccttatcccttgtcacagacaggcatgctaatgtgtttgatataggttctttactcttaaagaattcttacaagataagaaggttgttttctgagtgtgtgtatgtgtatatacgtgagtgtatacattttgcttaaagagtattgtgctataaatctaattttatttctaattttttcacagagcataacatccttcatacattcccacattgctgtaggttatttttggttgtttattcccctgtagctgctgcatagttttcaataaaatgaatcaaccacattttccctatccagtcttgcagtagaattcacactgatatcctgctactgaaatattcacttccttatggtatccttatgaaaacactttttggtcatgtgttacaatttgtcaggggctatgttagtctctttatattgctatgaagacatacccaatgctgggtaatttatttatttattttttaataaaagaggtttatcttggttcggggttctgcagactgcacaggaagcaatgctatctgctctgggtgaggcctcaagaagcttacaatcatggcagaaggtgaaggggagccagtgtgtcacatggtcagagagggagtaagagagagaagggggcagtcccaggctgtttctaacaatcagatctctatgaactcactgagaagaactcactcaagtggattgtgctaaaccaagcttgtctaacccacagcttgtgggctgaatgcaggtcaggacagctttgaatgtggcccaaatttgtcaactttgttaaaagagagtttgtgtatgtgtgtgtgtgtgtgtgtgtttgtgtgtgtgtgtggttttttttatttttatttatttatgtatttattttagctcatcagctatttttagtgtattttatgtgtggctcaagaaaattcttcttccaatgctgtccagggaagccaaaaggttggacattcctgtgctaagctattcataaggcatccaccccatgatccaatacctctcactgggccccacctccaacattggggatcatattttagcatgagatttggaggggacacacatccaaattatatcagggatatgtacccatcatcgagacaggttgtagagtatgcatactttcaaatgggtcctgtcatgttattttctgaaatggttaaaaccatttaattttccatccattgcccataaagcttgttttcctcatatcctcatcactcaatgttatctaggattcttatattttctaagcaagtggtgaaaatacagatctcattttatttgtgtacatttgcatttgtcagattgttaacaatgtattgaattttttggcccatttttctattgagtttactatcttctttgttcatctgaatatcaatcatattcactttgccctaagcagtgtcaacattttctattactctgtcatacatctgataactttgtatgccaacctttactgaaatgagcctttatgatttttatacttctagagtttatgtatttaattaaatttattggtttagtatatattttattaaactgtaacaacagtcccaaatctatgttttgctgggttcattcagatttagaactcagataactttttggaggataaattctttttatcataatgaagaatggctatcataatgcaatatgattacttctgccaatgcttattgttttatagtctactttgtttctgtggtcaggaggacaagacctgaatggccttgaccaactcagctttctgtacctcctagttctcagaataactttagaatgttccaagaagacaatatcctgagatgagtagaaaccgtctgggacagtctgggctctgtccttgttgttcctaggacaggatattactgcagcccttaaactcagagagccaaggtgcacgtggggtgtgaaacctagggcggagcactcaggggttcctcagcgcagtacacagtggggcatgtgcagaggagactccaccaaccctgggcaacttttctgacctcaagggtcaggcttgccatagaacttaacggttttgctgattcttcctgctcctctgtgagtaataaatttggtttgtctgacttactgtgcgagcattcttctgttcctggcagcttggtttatataaaaaacctcctactagacctatgaatctatgcaatgtggaagtgtcatagaggtaaataagaagcaacttaactgagttgaaaactaacatacataacatggggccactgcaccaaggggcaaaatgatcctgccaaaaagtcccatgtgaccattccagacatactgtggaagaaggatgctgaaactcacagagatctgaagatcttatccaagccaacaggaggctaataaagcaagagaattccactgtactctgatgcgagagtacaagcttcacctcagagaatagcaatgcaatggccccagcgatcagaccagagagaccctctgccacagagaaagcagaggtctagagaacagcatgaagacaataagagacttcagattcactttccctttgccttgaggccacagaaagcccaaagcatctgaacatcttcctggaggcatttaactaaaagagagctattgaaacttgaagaaaaatgtgaatcaagaagctaaatttaaagatatgttactttctccaaccatcccccaccaattaaccataggatgagtctagtgagataaagcatatcatttatacaaaatacaaaagttatatgtcctttatgtgggcagaaatatgttcaagctttactcaataaaggtatcttgttttactactagaaatggtaattttcacttggtcattactttattttataattatctctatttaaattagtatcagctcactcctgggtatccacctagaggaaaagaagtcatatgaaaaagacacatgtatgcacattcatagcagcacaactcacagttgcaaaaatgtgtaacaaggttaaatgtctatcagccaatgagtggacaaagaaaatgtgttatagatacaccatggaatactactcagccctaaaaatgaatcaaataatgacacttgcagcaacctggatggagttagagatgattattgtaagtgaagtaactcaggaataaaaaacaaatattgtatgttctcacttataagtgggagctaagctatgagagagtgaaggcataagaatgatttaatagactttggggactcagagggaaggttaggggggtgagggataaaagactacacattgggtacaatgtacactacttgagtaatgcgtacaccaaaatctcagaaatcaccactaaataacttttccatgtaaccaaaaaccacctgtttcccaaaaactattgcaataaagtaatatatatgaaaacaatcaacatgatagtcttgaagtgcaacattcactgggtttcatatgggagaaaaacagctaaaatcaaacacatggacaggcagtcagaacaatgtccatcatatacatagtaaaattaatacaaggacaaacattcatgagtggagtccatttgaatcagcctgtagtgaagacatgtgccttagggcacacataactcatgttagggagaaaatgtataattttactcaatgtgaaaacatcttcagaaataactcagtccatgctgtccagatgcagttctgttctgtagagatgaagaataagaatcatcaaagtggaaaaacctctgtcctgctccaaattctggtccacacaggagtagtactactggagagaaaagccatacatgtcccaaatgaaggaaagcctttacgttatcagtcatttcttatgagacatatgaaacttcacactggagagaaaccttatgaatgtaacaaaagtgagaaaggctttagatattccctacaccttaataaatatttaagaaagaacattctggagaagccctatggatgtaaggaatgtgggaaagccttcagcaaggctcaaaacatgcacatataaggagtcacactggaagaaaccctataaatgtgataaatgtgaaaaagactttgcaaagtcaccagaattaaaagccatcttaagattcacaatagtgagaagccctgtgagtggcagggaaatcatcattaatttttcaccgtactgaacatgtgaggaggacatactggaagggagctcaatgagttaacatgcatgagaacatctttcctgaactctcctatcttacagaagtgtgaaaagaaaccctctgaaggtaaagtctatggaaagcctttcatcttcattcatcgtgagtagatatttgttctcacactggagagaagctatgaaagtaaggaatatgaaaaaagcctcagtgttgtctcagactcatagttcatacaagaactcacacagcagagactgcttatggaagtaaaaaatgcagaaaatacctctttaaacactatccctcctttatacatgattccacaccctggagggagactacaattgaataaatataagaaagctttcagttccagctcttcacttattgggcatgaatgagcacagggtaggactgaagcacagtaaacgttaacaattattgactttatcattgtcttatccctcaattagaactcaaattcataattttgtagtttttcctttcttaaaaaatggtacaagatgacagatatctgtcttagcaacctttccgctctgccaccttaatgttgctatgtagtagctttgttacaattcatttacatacacatggtttcattttcagtgggaagcccttctgagctccattcaatttagatttagaattcgtatgctccatgataccttttttgtcagtttgttttttgttggtcacaatttgactgcattatggtcacattatgtggttttaatggtactgatttggggtacctgttatgactttcattttggtctaatgtggccaatgctgtccatttccctgctatatccattattctcatcttcttcactaagggaacatagattcactttttccaaggagcactgtttaaatgtctttatttatttatttatttatgcatattttattattttataacttttttttttgaaaaatggtctcactctgtctcccaggctggagtacagtggcatgatcagagctcactgcagtcttgaactcctgggctcatgtgatctcccagctcagactcctgagtaggtaggactgcaggcataacaggtgtgcactgccacacccagcttttgttttgttttgtttttgtagagactgggtctcgttatgttgcctggactggtttcaaattcctgtgctcaagtgattctcccaccttggcctcccaaattgctggaattacaggcatgagccaccatgcctggccctggttaacgtctttaaatgagtttcccagtttttctcgtaactgtagtgagcgaatcttatagtcctggccaatgtgaaatgcagaattcactgctttggatttctgaaaatctgtttggaaaggggagagttattgttcctcttttttgttgaccaatttccctttgctttctctgcttgctgctctctggaaataggatgaaatgccctgagttgggtttagcaacttgaagaccattggaaagattgtccctacaacaaaaccttcaatctacaagatttctccctccccaatggcatgttgtgtatccctggctgccgtggactatttctggacttgtttcatgaaactaacccctagtagaactaagaaacattttaggagagaagtttacaacagattaaatgataaacctaaaaaatgaataaaacatattataaaaataaagaggatagacaaaacgggcttgcagatgctgactggccacactcatccttggcgcttgcccccatggatgcctcactgactgacacttggagagctggcagccatcactcaaaaatcagaacacagtggcctctactgcagcatcagggaaccaaaactaagcttgtcagctctcaagaaacatacttatgtgtgtgtgtgtgtgtatatatatatatatatatgacataaatttattcagggactttgaggtatctcatgctaaacagataaaatgaattaaaactagtgcaaagttatggcaacagtactccccattatttatgcagggcgttgaaaactggcacacgtcacagatccttaagtcattctctgaatcaggaggagaaaagagaacagagagagctcactgtatgtgccagtcactggactgagtactgcgcctacgggatcccacttgatgcttgcaataaccctgcaagataaaggtaaaaactcacacacacacacacacacacaaactcacacacacactctcacgcatacatacacacacataaactcacacatacacacgcatcctcaagcacacactagaaactacagaacaaaaaagcattgacaactaatagaagtatactgctggccaaagtggctcatgcctataatctcggcactttaggccaggaattcaagacaagcctgggcaacatagcaagacaccatctacacaaaacattttcttaaataaacatcatttttaaaaagaggtataatgcctacaggctcagggaagcaatacccctatggctgtatggtaagcagcaggcaaggctatttttcagaccaaagtggtagtgactccagggttcctttgcacacttagccaggagattggctagctcagcactgcctgggttcactttacccttctacagttctaaagctctggcaggtgggacctaagcatcacagaaagtgctattatgcaggactctcttgactgcaagtgactgaaacctaactggatccagcagaacattgaattatttggctttacttactaaaaatgtacatgagtagatgggcttctgtctcagtgggatcaggggtcaactaatatcaaccaaggctcattctgtcccttcatttcctgtgtcagctctgcttttcaggcaagctgttttgagagagcagcaaaaatggccccataaagttcacatcacttacttccttacaaatagatatgccaataaaaagaaagcacctcattcccagcagtttcatcagaagttcagggatgacttccatgagcccagcttggatcacatgaccactcctgaatcaattaccctgctgatctgattgcccagggtgggtcagccttcccaaatcacatggactagtattgaaagacaggtcctcccatgaaaagaaaaaaaaaaaaaaaaaggaagggtagtggcagaggaatatgagtggggggggcctcatctctatataaaaagtatgagcgtatttgtgctcttttgtacattcatttgtatagtcactgggaaaaaaatgagaaaaacccaaacacggctttctatatgcctctgtgctttgttttcaacactgagctgtgagaaatctagttactaaaatgaaactgtgaaaaaatataacaatttgggacaatggggacacttagctgatgcagcacaggtgaacagttcttcttttgtgcccaagaggacacaattcccaggaggctgcatgtggtctcctaggacaagcctgtgggcacccactggctgcagttccacctttccttccctggactctcaggaagacatgagttctggattcagctgaactgagctcaagttcaagttctgtgactcactggctctgtaattctgggtaagtctcttgctctccttgagtctcatatcctccttggtaaaatggagaggtagagctattgttagattttgaaggcaaggcaagggttaaagaaagacagagaaagacagttgacggcttcaacagcaacacctttattactagcaaaaccctgcagaggaggaaaccagcttactgccagcaccaactgcctctcacaggctggggtgatcatgggactgggaaggaggggtgtgggcggtagagcttgctgcccggcaggatatggcaaggatgttcctgcagtcaggctgttgggcctttgcccgggagggtgcgataaggatgtttctacagtcaggtgatcaggaaggatgcttctcacggcccgagttcccaaggaatgtttcattctgaccagggtgtgcaaaacggctgcaggtttacaaaatggtacaggttagactaacagcaacatctcccaggtagacagttctataaagtaaacttcccttgagcacctacactgtaccagacatggtgctaggacccaggccacaggaggaacaggacagatgaggcccctgccatcctggtgctcatgcctgatgaaggaagctaacaggtcgtaagaccaggtcacgtggtggtggtaatgaaagacattaccagccacttcgaggtccctgccagaacctgactgccacattccccaaagggaccagactcctcggcacactagctgaggtttctataggcacagagaaaacactgtcccaactgttgcaatggagctgggaaaaataatgttttttctcaatgcttagacttaccaattgcttcattttatcacatgaaggctgtgtggcactttgaagtagaattagtaatttacataattacaaatcatgtttttttctttttttttagatggagtcttgctctctcgcccaggctggagtgcagtcgcgccatctcggctcactgcaagttccacctcccgggttcatgccagtctcctgcctcagcctcccaagtagctgggactataggcgccaatcatcatgcccagctaattttttgtgtttttattagagacggggtttcaccaagttagccaggatggtctggatctcctgacctcgtgatctgcccgcctcggcctcccaaagtgctgggattacaggcataagccactgcgcctggctacaaattatgttcttaaaagaagctgctcagtgccatgcctaacacaagatggaactccacgatgagatatgtgtgaagacagggtgccatggttacaaacaaggactccaggtgcagactgtttggttcaaacctggaccagcggtatgaatttttgcaactctctgtattgctctttgcctcagttttttcatataacaactagaagtaaaaacaaggttattgtgaaaattaaatgaattaaagtaagtggagtgcctacaacacccccaggcacacggtcagcactgagcatgtttttcattactactcttaatgaggtaagaatgagaaaacaggcgccagccatgagcctggggtttatctggcaaaggcatcagagaccccacttttaacatcctccattcattcatttgaccctgataaggaaggagtctcatgggagaggagcaagcctccacctgggggccagacatctcatgatcaaagttgaactctaccactgttcagctgggtgactttgggcaagtgactttccctctctgatcctcatgttcctttttgataaaaacagcaaaatgtcaggcctatggggattcaaggagccaaaagaaaaatgtgtgtcttagtctgaatttcctggaagtagatcctgaggcaaagattcaaatacaaaaattttgtttggagataacgctaggatattaattcgactgccagttcttccttagggtgctaatcccaggaaacatcagtggaggagtggggaactgagacaggaaaggaatgcagcagttaaagggaccttcatcaagaaagtttccactgtggcagccaggactcagccctgccaggtacctctgagagacagcacagaacatgtgcttcagagtcatcatacccagagcaagggaccaggggtatttatccaccaatacccaccagtcactcctcagggatcctcccaagggcatgattcctccagaatgtcctgcctgcgctgcaagggtcagacctggggttgagggcaggacccctgacagcgcttccagcaatgggcagaaccacagcctgatgtgtacagtttcagtcacccagtaactccaacacacacacacacacacacattcacacaccacactccaacaccaacaaagtatatacgtacatacacatacatgcatacatgactgttacccacttagatcctagtgactccatgggatagacgataaggtgggaatcagaggaaagagtaaaattaaggcgagtgaaagtcttaagaacaaaatgcaaatttaggctgaaaatgaagggggaggaggtgtggtctcgacaccaaatgcctgctgggtggcacatgctctacacacactgtcactaattctccaagcagcctcgtggagtaaaagaaattcctctcaatgtacagatgacagaaacatagttcagaaaagaaaactgattttactaatgtctcagcaagttagtgggtgacatggagtcccagatctttctgtccacaaagcctacaaattctcccttgttaggcaggctgggtaccaggccctgcttctgggctctgcttcttttccttctaggctaaaacagcagaactgacagagacatcatcccccttctccacctggagcagagccaatgagaggggctggggaacagccatgaggcccagcacccaccattcaatgtcttcagaattgccgtccctcagaactcttgcaccacgaggtggcagcactcccagtgtctgggtgtcttctgaggggtaccaggatccagtagaggccactggctgtgctgtcatatcctaagtggcagcaaggcaggcttgggtctcttggctgcttcagcaccagaggttggacagtgcccatgcattgagtccctcaggagaatgggagggaaaggaagggcagaatggagtgatgtagggtccatccaccatgtccctggatggagagacccctgctcccacagtagtccacaccaggaccacgattggcactcatgaagatgccagcctccatgtatatgtccttgtctgacaactcctccttattttcatcctggagacaagaaccctgaacacagtagctctgagggcacctgagtgtaacctgagacagtccctgaagacctttcatccaagcaggatccctcccttgccatctgcagacctgccccacaaactccctccctggtctcctggctcttgttcactccttccaggcagccttccacagtcatctctaaaatatatatgactgtcccttcctttatccagcaccttccatggctccccagagccctccaggtcaagttcaagttctttgatcagacactagatctcaagctgcattctacctcctgaattaagatcccggagaagcccaccttgctcagcacaaacgcatcactgaagtcgaaaatcttgaacgtggccttggcattgaggaagtcatcaacaccctggctagtgagggtgcagtgccgctccaggatgatggtgtctaaagttgtgcaccaggtcgcaggccctgcagaagcatctcccctcaggagtgaggtagtacaggaagtctgtgcacaggcagatctgctggtgctgttacactatgagggcactgagctccaagatggtggcaatatattcactgggattcctgcacggtgaggttggagagaggaagcatctccataacacatatgaaaccctggaagcacttcccagccagaaattcaggaccacgttatatgcagatatgggtgccctctgagcacacttgtctctgtctcccactctgagctgcctcctggccccacatgccccagcctggcccagggcttagcccagtgggtgttcagtccatggtgttgactgctccctgggccaggagagcccttggtggctctgtgactcctcctgtggaacccctacctctgccttgggacctcccaattcccatggaagcccccacagctctggattgccccacctgccctgtgatcctccagccccataggccttactcgatgccttagccctcccagaacatgacacgtttctctgaatgtggctgatgtccagggccatctgtagatgtttgctggggacctcttgctgttttcctttatggtctgtaggccagggccaagaggagaaaccagcctaatctcagaatggacaaaaggctcactgccctaacagcaaccaccaaacagtcagcagtgcttctggatggaaaagaggtttcattctgcagaaagctccttgtttggcttctttctgaagccaggaaggggtaccaaacccagcttacctgcggtgcctacgttagcatctgtgcctaggatgcatgatgggctcccactgcagggttgacattccctccagctggagacctgggctcctgacaccacctggcgtgtttgtcctgctctggatgacggtggaaaggctgtatctggtattttcctaggtccttggttttcaccttctagacatccagcaggagtgaccatacccagccccacacctgaaatgggactcccttgtagagcacctgagacctctacagacagaagagtgctctggtgagacaggccacagaggtccccgggggggggggggatcaggggctggaggattctggaggtttccagccttgggctctgtggttcctcaaagagtttaggtttacctaggactaggcctcccctcccatgattcaaagagtgggtgagtgctatgcatcacgaactctgatctggacctattttttcatttaggtcaccaagagacaacccctaacccccaagctagggatggtccaagctctggcatgagattctcttccagcaatgtgatgcttgcagggacagggagaaaagccggtgaccaggcctgctgtcccccaggtaaggacagtgtgctacccaccctctgagaggcaggtggtgccaggtcactgcactgggtccctgtacccctggctctgcagacaccagtcatggaggtcctcccctctccacattaccttcttgctactcccagatttcttctggtcattaagcactttgagccatttttctgtgcagccgatctgatatttttgctatcagatgaaacatgacaaagtaagccgagccaccaggattcctggagggaaccttggatgctgcgtcttgggatccagagccctgatgggactgaaccagaaggagccagggaaggacaaacactggggctcaggccctatgacccaacggccattggtggcctgtcctcatggccccaagacaccctgtcctcaggccacagacaccatgggctttggtcaggtcccagcctcccagtagtgccctggcactggtgggtgctgacccccaaaccacaatagcagttctgggttatgggtttggtaaaaccacctcagggagaattctggggttgggtttggcaggaaccacggggcctcccaggaatgatgtgtcactcctacttgccacaaaatgtgcacagaggctatcccactgaccagcccatcctgctggacaggatggaggaaatcagggaaaaggcagggtggacatctggggtgcagggagaggcaggtgcatgctgggaggtcagaccctgcgagggctgtgggggcatcaggtggggtgggctccaggtgcaccctcaatgcactgggtgggtctcaggccaggctccctggaccctggttggctgatgtggtcactccctgggggactgctgtcaagccctggccacccaccctgggcagcaccgtcccatcccaagaccggattttctgagtcctgagacaggacagtgctgtccaggcctgacagactgggaggacctgccaagtcctccatccctagaccagcctcccacacagcagggacagtctcttccatttaccttcagggcactgactgatccatgtcactctaaggcaaccaaggcagagctgaggacctgtgccaggctgggagccagtcccctccctaaatgggcctgaggaaagcaccatccctgtcccaatgcgccccaagttttagcccaggagacacatagggaagggaggacggagcctctctgctggctgacacttgaaaagcgggacctgggagtagagggagcgcagggctggcagggatgctccaggcccatggagagcttgggctgcaccaaggggctgcccctcctgggctggaggctgtgccctctgcaggatctgagaaagtccagtcctgagatgggacagtgctgccaagggtgggtggctaggcctgacagcagtcccccagggagtgaccacatcacccgaccagggtccagagagcctggaccgagacctgcccagtgcacactgagagtgcacctggagcccaccccacctgacgcccccacagccctcacagggtccgacctcccagcatgcacctgcctctccctgcacccctactgcccaccctgcctgttccctggcttcctccatcctgtgcagcccatagactgttaccatctctctagccactctggcccttcctttacctttgttctttcagaatctctgagcaagatctcccaggtccatccaaacacctgctttgtccacttttgactgggccattggacaccactgggccatcccagctgtccatagggcccctgataacatgcatttcccctgacacctcccagcagtgctcagcagccccactgaccaggtccctgctgaccagatcccgcacatcaggtcctccctgaccacactctcactgattaggcccccatcaccaggccccactaactagattcccgctgccaggcccacagtgtccaggaccccactgacaaggacctcactgacaaggcctcactgaccagggcctcactgacaagacctccctgaccacattccaccaatcatgaccccattgcctggccccacagatgaagccccactgaccaggtctccagggaacaggctgccagtgaccaggtccctactaaccaggcctgaggtgaccagatgccccgaccaggaacctagtgactaggcaccactgaacaggcatgtaccgctcagacccccgttgaccaggtcaccccatagaccagtgctacaaaagccaccactgatcaagtcctctctgaccaggcccccactgattaggttccactgacctgaccaggctgccatgaccagggtcccactgacaagggtctcactgatgaggacatgccctgctgactaggtgccatgtgaccaggcctccactgaatagcaccccttgaccgggtcaccagtgacccagcccattctgacaaggctaccactaagccacagctgaccaggtctccactcaccaagccctgcagcccaggtttgcactgaccagacaccaaacatttgtctgccactaggtccccactcaccaagacctgcactactcgatccctctaatgagaccctctctaagcagaccctggctgaccattcccccagtaaataggcctcactgaccaagtcccaactgactagttcactgaccaggcccacactgaccaggcccttcctaatcataccagaaggccaagtggcaatgagatgtttcatatggcaggggtaggagcaagacagagagaggaaagaggtaccacaccctgttagacaaccagatcacatgaggtctcactatcaggagatcagcatcaagaagatcctgcacccacaccaccgcccactgtttccaggcagaagcctcctgcagaggccaagcctcttgagaaacttccactatggcagtgcagaaggaaaatatgggcttggagcccccaaaaaggaggccaccatcctccagatcccggattcataggcccaccaacagctcacaccctcagtatggaaaagctacaggcactcaacaccagcccagcccatgagagcagccatggggctaaagcctgcaaagccacaggtgcactgccctagtagaggttttccatgagcctctgcctctgcagaaggctactcccccttcctactaccccccatcctcctaccaccctactgacaacctactcctccccaccctacccctccttttcctaccaccccgaaccccctcccattcaagattaaatcgcctaccaccaggccccaaaattaaggattacaattccatatgagttttatatggacacacagtcaatccatattatttgacccagataccccagaacctcatgtccttctcacacagcaaaacacagtcatgcatgttcaaaagtttccaaaattcttaactcattccaaatataaaaaattcaaagtctcatctgagacaaggctacagtcccttcggcctatcagtccctgagttcaaaaggcatttcttttctttcaagatacaatgatagtacaagcattaagtaaggtttctcaatccaaagggaagaaattccccagaaaaatgacaaaaatgtcagtccaaaccccagcaggacaatattcactcaatctttaagctccataatcatcaagagaactcactatcacgcagacagtattaaggagatagtgtttcaccagttgtgaagaatccgtcccccctcatttttcacccccacccacaaaataatctctcctattctccccactcccccacctccaacccccactcttctccatgattaaatcatctcccaccaggccccacctttaacattccccattacaatttcacgagagtattggtagtgacacagggccaaatcatattattctcacccaggtccccccacatctcatatcgttgtcacactgcaaaatacaatgatgccttctctacagtcccccaaagtcttaactcattccagcatttactgaaatgtccaaagcccagtctcatctgagacaacgctgccatcccttctgctcgagcctctgaaatacaaagcaagttaactacttccaaggtacaatgattgtagagacattgggtaagcattcccagccaaaaggaagaaatttgtcagagggaagcacaaaacacagatgggacttgcagaccccatgcaagtcaaaaacccagcaggaaagtcattccatcctacagctccaaatcatctttcctgaaaggatctacatcccacatctagagcacaagagtggatggcggggctcccaaggccttgggcagctcagcttctgtggctgtgcagggtctttccccacagctgccctcgtgggctgggctggtggtcagtgcctgtggctttcccacactgagggtgcaagcagttggtgggtctatgaatctggggtctggaaaatggttcctccctgtatgggggcatcaaccctgtatgttccttctgcactgccctagtaaaggtttcccatgaggctctgcctcttggaaaagcttctgcccagctggacactgaggtttttccttacatactcttgagtctagacaaaggctcccaagcctgtgcacctgctggcttaacactatgtggaagccaccaaggcttgcagcttgcaccctctgaagcagtgacccaagctgtacctgtgcatctttcagccatggctggagctggagctggagctgcagggatgcaggcggcactgtcctgaggatggacacagcagcgcgaccatgggactgacccaggaaaccattctttggtcctagaactcagggcctttgacagcaagctctgctgcaaaggtctctgaaatgccttcaaggcctttttaacattgtcttagctattagcactgggctccattttatgcacatttctgaagccttcttgaattttcccactaaaaatcagcttttctttttgacctcttgggcaggctgcaaatcaaacttcaaagctctgcttctcatttaaatataagtttcaacttgaggtcatttatttggtcacacagaacaccacaggctgttcaatacagacaagatacctcttgagctttgctgcctagaagttcatttcaccagatataccctaaatcatcaccctcaagttcaaagtttcacaggtcaccagggcaggggcaccatccagccaagttctttgctaaggcaaaagaaaagttaccttggcttctgctcccagtaagttgttcattttcatctgagaccttctaagcctggccttcactatccatccttcagtcacccttttaattataactatttaacacatctctacaatagtcaaaactttcattcatctttctgtcttcttccaagccctccaaactgtgcagcctgcggtcgttacccagcttctgaacctgcttctgaacttgcgtctacactttcagctatcgttgtgacagcctggcagtgtggtaaaagaaaaaaagtccattttcagggggaaaattcaagaaggcttcagatatttgcatataaaagaagccaaatgttaatagtaaaaaatcaggaaaaaaaccttgagggcatttcatagctccactctacagtacaaattttctgtagtattattttaaaaagaggtttaattggctcacggttctgcaggctgtaaagggaacatagtggcttctgcttctgggaggactcaggaagtctcctaccataccagaaggccaagcgacaatgagatgttccatatggcaggtgtaggaggaagacagagagaggaaagaggtgccacacttgttatacaaccagatctcatgagaactcagtatcaggagatcagcatcaagaagattaaccattggtgaaggatccacccacaccaccccccactgtttccacgtagaagcctcctgcagaggcagagcctcttggagaacctctaccagggcagtgcagaaggaaaatgtaggcttggagcccacatacaggaggccaccatcctccagactgcagattcatagacccaccaacagcttgcactctcagagcagaaaagctacaggcactccacacgagcccagcccatgacagcagccatgggggctacaccctgcaaagccacaggtgccctgccctagtagagactttccatgagcctctgcttctgaagcaggttactcccccctcctagtacccaccaccctactaacaacctactcctcaccctacccacccctttccttccatccccggtccccctcccatccatgattaaatcacctccagccaggtcccacctccaacattaaggattacaattcacatgagttttggtaaagaaacacagccaaatcatattattctgacctgataccctgcagtctcttgtccttctcacagagcaaaatatattcatgtcttttcaaaattttccaaaagtcttaactcattccaacaataactcaaatgtaaaaaattcaacatctcatctgagacaagtctacagtaccttttgcctatgagtccctgaatttaaaaggatgttctttctttcaaggtacaataatggtacaggcattgggtaagctttttcaatccaaagggcagaaatttcccaggaaaataacacaaatgggaccacaggcccaatgcaagtccaaaacccaggaggccagtatccatttaatcttacagttctaaaatcatgaaaagaactcaccgtcacaaggacagcaataaggagatagtgtttaatgatttgtgaaggatctgaccccccaccccaattttcacccctcacccccaccataattcccccattttccctacacccccatcttccaacccccactctgcaccatgattaaatcatcttccaccaggccccacctttaacattccaattacaattccacatgagttttggtagggacacagagctgaattttattattctttccctcactccccaaatctcatgtccttctcacattgcaaaatacaatgatgccttccctaaagtcccataaaatcttatatcattccagcatttatacaaatgtccaaagcctaaagtctcatctgacacaaggctacagtcccttaggcccatgagcctctgaaatataaagcaagttaactacttccaaggtacaatgcttgtacaggcattgggtaagcattcccagccaaaaggaagaattttgccagaaaaaaaaacaaaacacagataggacttactggccccatgaaactccaaacccagaaggccagtcattcaatcctacagctccaaaatcaccctttttgaaaccctgtcccacatccaggacacaggggtgtgagggctgggctcccaaggcctcgggcagcttggcacctgtggctttgcagggtatatgccccaagggtgccctcatgggctgggctggtgatgagtgcctgtgacttttccacattgaggaaacaagttttgggggggggggtctatgaatctggggtctgcatgatggtggtctccagtgtgggagttccaaccccatattttccttctgcactgccctagtagaagtttgatataaggctctgcctttttgggatgttttgcctggacacccaggaatttccatacatcttccaaaatctatagagaggctcccaagcctctagtctcacactccgtccaccagtggcttaacactatgaggatgttaccaaggtttctagcctgcatcctctgaagcagtgacctgagctgtacctgtgcatctttcagccatggctggagcttgagctgcagggatgcaggcagcagtgttctgaggctgcacatagaggaggctcatggaactggccaaggaaaccatgcttctctcctaggccccagggcccacaatagcaagggctgctgcaaaggtctctgaaatgccttcaaggcctttttccctattatcttgtctattagcaccgggctccttttcatgcaagtttctgaagccttcctcaattttccccctgaaaatcagcttttctttttgaccacttggccaggctccaaattttcctaaatttgagttctgagagacgggactcatttaatgtaagtcccatccagaggttatttcctccatcacacataagagcacaggctgttccatggggacaggacacctcttgagatttgctgcccagttcattccaccagatactcagtaagtcatcaccctcaagttcagtttcacagatctccagggcagggtcaccgtgcagccacattctttgttaaggcaaaacaaaagtcactttggcttctgttcccagtaagttcctcattttcatttgagaccttctaagtctggctttcactcaccattttcctgtgagccttctggtcacaagtatgtaacaattctttacaaagatccaaactttccctcaacttcttgtctgcaaagccctccaaactctctgaactctgtctgctacccccttctgaacctgcttctacattatcagctatctttgctgcagcctgacaatgtagtaagggaagacaagtccattttcagggggaaaattcaagaagggttcagagacttgaatgaaaagaagctgagtgctcactaccaagacaatagggaaaaggccttgaagacatttaatagacccactttgcagtactaattttctctatgatcataaagaagaggtttacttggctcatgattctgcaggctataaggaagtatagtggcttctacatctaagaggaatcaggaagcctcccagtcataccagaatgtcaaggggcaatgagatgattcatgtggcaggaggaggagcaagacagggagaggagagaggtcccacaccctattatacaaccagatctcatgagaactcactatcacaaggtcagcatcacaaagatggtgcttaaccactggtgaaggattcgccccctacccccaactcccactatttccaggcagaagcctgaggcagaggcagagcctcttggaaaactctactagggaagtgcggaagggaaatatgagcttggagcacccacacagatggccaccaacctccagaccccagattcatagacccaccaacagctcacaccttgtgtggaaaagctacaggcactcaacaccagcccagcccatgagagctgcggcaggggctaaaccctgcaaagccacaggtgcattgccctagtagagggtttcccatgagcctctgcctctgcagcaggctgctcccccttcctcccacccaccaccctcccaccaccctactgccagcctactcctccccaccctaaccaacccttttccttccaccccaaccccttccagtccatgattaaatcatctcccccaggccccaacttcaacatttggaattaaaattccacatgaattttcatagggacacacagccaaaccatattattctgaccctgctatcccagaatctcatgtccttatcacagagtaaaatacaatcatgccttttcaaaagttccaacagccttaactcattccaaatgtaaaaagttcaaagtctcacctgagacaaggctactgtcccttctgcatatgagtccctgaatttaaaagggatttcttttctttcaaggtacaatgatggtacaggcattgtgtaagctttctcaatccaaagggaagaaatttcccataaaaataacacaaatgggaccacaggcctaatggaagtccaaaacccagcaggacagtattcactcaatctttaagctccataatcatcaagagaactcactatcatgcagacagcattaaggagatagtgattaaccatttgtgaagaatccacccccctatcctcatctttcacccccacccacaaaataatctcccccattctccccaaacccctacttccaacccccactcttctccatgattaagtcaccttccaccaggctccaactttaacattccccattacgattccacatgagtattggtagggacacagaaccaaatcatattattctggcctttggtccccaaatcttgtatccttgtcacactgcaaaatacaatgatgacttctctactgtcccccaatgacttaactcattccagcatttactgaaaagtccaaggacttacagaccccatgaagtcaaaaacccagcaggccagtcattgaatcctgcagctccaaatcatcttttctgaatctacatctcacatctagagcacaggcatgtgatggctgggctcccaaggccttgggcaactctgcacctgtggatttgcatgatatatcccccacagctgccctcatgggctgggctgtgttgagtgcctgtggcttttccacactaagggtgccagctgttggtgcatctatgaatctaaggtctggagaatggtgtctccatatttagggactccaaccccattttctccttctgtactgccctggtaaaggtgtgccatgaggctctgcctcttggaaaagcttctgcctgaacacccaggtttttccgtacatactctggagtctagacacaggcccccaagcctctagttttgtgctctgtgcagccgctggcttaacactatgtggaagacaccaaggcttggaacttgcacccctgaagcagggatgcaaactctacctgtgcatctttcagccatgactggagttggaaatggagctgcagggatgccggcagcagtgtcctgaggctgcacatagagggggctcatggaactggcccaggaaacgatgcttctctcctaggccccagggcctgtgacagcaagggctgctgcaaaggtctctgaaatgccttcaaggtcttttccttattgtcttggctattagcaccgggctccttttcgtgcaaattcctgaagccttcttgaattttcccactgaaaatcggcttttctttctgaccacttggcaaggctgcaagttttccagacttttgagttctgtttctcatttaatataagagttgtgactcatttaatgtaagacccatccagaggtcatttcctcagtcacacaaaagggcaagggctgtttcatgcagacaggacacctcttgagctttgctgcccagaagttcattccaccagatactcactaagtcatcaccctcaagttcaaagtttcacatatctccagggcagggtcaatgtgcagccacattctttgctacagcaaaacaaaactaaccttggctcctattcccagtaagttcctcatcttcatctgagaccttctaagtctgatctttactgtctattttcctgtgagccttctgatcacaagtatttaacaattctttacaaagatccaaatttcccctcaatttcttgtcttggaagccctccaaactctcctgaactcagtctgctacccccttctgaacctgttcctgcattatcacctatctttgtcaaagcctggcaatgtggtatggaagacaagtccattttcagggggaaaattcaaggaggattcagagacttgaatgaaaagaagctgagtactgatagccaagacatgggggaaaaggccttgaagacacctaatagatcttctttgcattaaaaatgctctcaatgatcaaaaagaaaagaagtttaattgttaatgattctgcaggatgtaaggaggcatactagtttctgcatctcagaggactcaggaagcctcccaatcacaccagaatgtcaaggggcaatgagatgtctcatatgccaggagcaggagcaagcatgagagaggaaaaaggtgtcatgccctattatacaaccagatctcatgaaaactcactatcatgaagacagcatcaagcacatgctgcctaaccattggtgaaggaactgcctcccacacccacctcccactgtttccaggcagcagcctgctgcagatgcagagttcttgggaaacctctactagggcagtgcagaaggaaaatatggacttggagcccccacatagggggctaccaccgtccagaccccagattcacagacccaccaacagctggcaccctcagtgaggaaaagctacagaccctcaataccagtcccgcgcatgagaacagctgaggagctaaaccctgcaaaccacaggtgcactgccctagtagagggttttccatgagtccctcactctgcagcaggctactcctccttcctactaccacccaccctcccaccactctactaccgacccactcctcccaatcctacccatcccttttaccttccaccaccaccaacctcccgtccataattaagtcacccgcttcaacattagggattacgattccgcatgagattcatagggacacacagccaaaccatattattctgaccctgatatcccagaatctcatgtccttatcacagagcaaaatgcaatcatgacttttcaaaaatctccaaaagtcttaacgcattccaaatgtaaaaaaattcaaagtctctcctgagacaaggctacagtctcttctgcctatgagtccctgaatttaaaatggagttcttttctttccaggtacaatgatggtatgggcattgggtaagctttctcagtccaaagggaagaaatttcccataaaaatagcacaaacgggcccacaggcccaacacaagtccaaaactcagcgggacagtattcactcaatcccacagctgcaaatatcatcaggagaactcactatcacacaggcggcattaaggagatagtgtttaaacatttgtgaaggatctgccccctacccttaccttttacccccacccacaaaataatctcccccattctccccacacccctacctccaacgcccactcttctccatgaataaatcacctcacaccaggccccacgtttaacattcaccattacaattccaaatgagtttggtagggatgcagacccaaatcgtattattctgaccctgaccccccatatctcatgttgttctcacactgcaaaatacaatgatgcctactctacagtttcccaatgtcttagctcattccagcatttactgaaatgtccaaagcccaaagtctcttctgagacaagactgccatcccttctgcccctgagcctctgaaatacaaagcaagttaattacctccaaggtatgactgtccaggcattgagtaagaacctccacccgaaaggaagattttttgccagagagaagaacaaaacacaaacgggacttacaggttcccatgacattccaaaacccagcaggccagttattcaaacctacagctccaaaatcattctttttaaattcttgtcccacatctaggacacaagggcatgagggctgggctcccaaggccttgggcagctctgcacctgtggctttgcagtgttcagcccccgcagctgccctcatgggctgtgctgctgttgagtgcctggagtttttaacccatggagggtacgaagcttttgatgggtctatgaacctggggttggcacgatggtggcctccagtgtgggggctccaacctcatattttccttctgcactgcccaagtagaggtttcccatgagactctgcttttttggcagccttctgtctggacaccaggcatttccatacatcttccgaaatatatttatatggaggctcccaagtctctagactagtgctccgtgcacccactggcttaacactatgtagaagccaccaaggcctatagcttgcaccctctgaagcagtgacccaagctgtacctgtgcatctttcagccaaggtcggagcaggagccggggctgctgggatgcaggcagcagtgtcctgaggctgcacacagcagcagggccacggggctggcccagcaaaccattcttctctcctaggtcccagggcctgtgacagcaagggctgctgcaaacatctctgaaatgcctccaaggcttttccccacaattgtcttggctattagcactggcctccactttatgcaaatttctggagacttcatgaattttccccctgaaaatcagcttttctctttgacaacttggccaggctgcaaatgttccaaacttttgagctctgcttgtcatttaaatataagttccaacttgaggtcatttccttggtcacacatgagagcgcaggctgtttgatgcagacaggatccctcttgtgctatggtgcctagaagtttattccaccagatatgcactaaatcatcaccctcaagttcaaagtttcacagatctcaagggcaaggtcgccctgcagccacgttctttgctacagcaaaacaaaagtaaccatggctcctgttcccagttaagttcctcattttcatctgagaccttgtaagcctggccttccctggccttccttctgtcagcattttaatcaaaactatttaacaagtctctacaatggtcccaactttccctcatcttcctgtcttttttcaagctctccaaactctccaacctctggctgttacccacttctgaacctgctttacattttcagctatctttgttgcagcctggcgctcctgcctttcacccgtaaccccaaacacaatcccaatcccccacaactctccccacccccccaataccctccaactctccccatcctcccccccatccaacctccactctccaccaggggaaacttcaagaaggcttcagatatttgcgttaaaaagaagcccagtgctaacagccaaaacagtggggaaaagtcattgaagatatttcatagctccactttgcagtacttattttctgtgtggtcataatgaaaaggggattcattggctcatgggtcttcaggctgtaaagaaagcatggtggcttctgcttctgggaagactcaggaagcctcccaatcataccagaaggaaagcagcaatgaaatgtttcatacggcaggagtaggagcaagactcacagaggaaagaggtgccacagcctgttatacaaccagatctcatgagaactcactatcactaagtcagcatcaagaagatggtgcttaaccattggtgaaggatccaccccccaacacacctccaccccctactgtttccagacagaagcctgctgcagaggcagagcctcttggaaatcctgttctgtggcagtgcagaaggaaaacaagggctttgagtcgctctgcaggaggccgccctcctctagaccccagattcatagacctaccaacagttcacaccctcagtatggaaaagccataggcactcaataccagcccagcccataaaggcagccatgggggctaaagcctgcaaagccacaggtgcactgccgtggtagaggttttccatgagcctctgcctctgcagcaggctactcccccttcctactacccaccaccctccgaccaccctacagccagcatactgttccccaccctacccaccccttttttcttccacccccacacctcccatccatgattaaataatctcccaccaggccccacctccaacatttgggattacaattccaagtgagtttttctagaggcacacaaccaaatcatattatgctgaccttgacccccccaaatcccatgtccttctcacacagtaaaatacaatcacacctgttcaaaagtttccaaaagccttaactcattcccgcattaactcaagtgtgaaaagttaaaagtctcatctgagacaaggcccttctgcctatgagtccctgaaattaaaagcacactcctttctttcaaggaacaatgatggtacaggtattgggtaagttttctcaatccaaacggaagaaatttccaagaaaaataacacaagtgggaccacaggcacaatggacatccaaaacccagcaggtcagtgttcattcagtctcacggctccaaaattatgaagagaactcactatcagaaggacagcattaaggagactgtgtttaaccatttctgaaggatccacctccacacctgcctttcacccataaccccaccacaatcccaactctccccatcccccgaaaaaccccccaactctccccaccctccaataccctccaactctccccatcccccccatccaacatccactctccaccatgattaaatcaccttccaccagcccccacctttaacattccccattaaaattccacaagttttgggggaggcacagagccaaatcatattattctgtccctggtcccccaaatctcatgtctttctcacattgcaaaatacaatgatgccttccctgcagtcccccaaatcttaactcattccagcatttactcaggtgtccaaagcccgaagtcttatctgagacaagtctacagtcccttctgcccatgagtctctggattataaggcaacttcactacttccaaggtataatgattgtacaggcaatgggtaagccttctcagccaaaagaaaaaaaaaaaaaaaactgctagaaagaagcacaaaacacagacgggattcataggatacatgaatgtccaaaacccagcaggccagtcactcaatcctacagctccagaatcatcctttttgaatccctgtcccacatccatggtacaggggtgtgagggctgggctcccaaggtcttgggccaatctgcacctgtggctttgcagggttcagcccctgcagcggccctcatggacacagctggtgttgtgtgcctcgtagcttttccatactgagggtgcaagctgcttgtgggtctatgaatctggggtttggagaatgatgcctccctgtgtgggggcttcaaccctatatgtcccttgtttgctcccctagtagaggtttcccaggaggccctgcctcttggaaaagcttctttcctagacatccaggcttttctgtgcatcttctggagtctacacagaggctcccaagcctctagtctcttactctgtacacctgctggcttaacactatatggaaacaatcaaggcttggagccacctctgaagcagtaacccaagctgtacctgtgcatctttgagccatggctggagctggaactacagggatgcagccagcagtgtcctgaggatgcacacagcaatggggccatggagcttgcccaggaaaccattcttctctgccaggccctagggcctgtgacagcaagggctgctgcagaggaccatgaaatgccttcgaggcctctttcccattgtcttggctatttgcactgggcttctttttatgcagatactctaagccttcttcaattttcccccggaaaaccagcttttctttttgaccacttggccaggctgcagattttccaaactttaggtctccacttctcatttcaatagaagttccaacttgaagtcatttcttaggtcacgcataagaacacaggctattcaatgcagacgggacacctcgctaggctgcctagatgttcattccaccaggtacatccgaaatcatcacccccaaattcatagtttcatagatgtccagggcagggtccccgtgcagccacgttctctgctaaggccaatcaaatgtaaccatggctcctgttcacaggaaattcctaattttcatctgagaccctttaagtctggacttcagtgtttatccttctgtcagccttctgatcgcaagaatttaacagttctccacagcggtcaaattttcctcatcttgctgtcttccaagctttcccaactctcctgacctctgtcttttacccacttctgaacctggttctacattgtcagctatctttatcacaacctggtagtgtggtaaaagaagaaaagtccactttcagggggaaaattcatgaaggctccagatagttgcatgaaaagaagctgagtgctggttgccaagaaaaggggaaagggccttgaaggcacttcatagctaccagaatgccaaggggcaaggagacatttcaaatggcaggagtagaagcaagactgagagaggaaagcggtgccacaccctgttatataaccagatctcatgagaacgcactatcatgaagacagcatcaagcacatgctgcctaaccattggtgaagggactgcctcccacacccacctcccactgtttccaggcagcagcctgctgcagatgcagagttcttgggaaacctctactagggcagtgcagaaggaaaatatggacttggagcccccacatagggggctaccaccgtccagaccccagattcacagacccaccaacagctggcaccctcagtgaggaaaagctacaggccctcaataccagtccagcgcatgagaacagctgaggagctaaaccctgcaaaccacaggtgcactgccctagtagagggttttccatgagtccctcactctgcagcaggctactcctccttcctactaccacccaccctcccaccactctactaccgacccactcctcccaatcctacccatcccttttaccttccaccaccaccaacctcccgtccataattaagtcacccgcttcaacattagggattacgattccgcatgagattcatagggacacacagccaaaccatattattctgaccctgatatcccagaatctcatgtccttatcacagagcaaaatgcaatcatgacttttcaaaaatctccaaaagtcttaactcattccaaatgtaaaaaagttcaaagtctctcctgagacaaggctacagtctcttctgcctatgagtccctgaatttaaaatggagttcttttctttccaggtacaatgatggtacgggcattgggtaagctttctcagtccaaagggaagaaatttcccataaaaatagcacaaatgggcccacaggcccaacacaagtccaaaactcagcgggacagtattcactcaatcccacagctgcaaatatcatcaagagaactcactatcacgcaggcggcattaaggagatagtgtttaaacatttgtgaaggatctgcccccctaaccttaccttttacccccacccacaaaataatctcccccattctccccacacccctacctccaacgcccactcttctccatgaataaatcacctcacaccaggccccacgtttaacattcaccattacaattccaaatgagtttggtagggatgcagacccaaatcgtattattctgaccctgaccccccatatctcatgttgttctcacactgcaaaatacaatgatgcctactctacagtttcccaatgtcttagctcattccagcatttactgaaatgtccaaagcccaaagtctcttctgagacaagactgccatcccttctgcccctgagcctctgaaatacaaagcaagttaattacctccaaggtatgactgtccaggcattgagtaagaacctccacccgaaaggaagattttttgccagagagaagaacaaaacacaaacgggacttacaggttcccatgacattccaaaacccagcaggccagttattcaaacctacagctccaaaatcatcctttttaagtccttgtcccacatctaggacacaagggcgtgagggctgggctcccaaggccttgggcagctctgtacctgtggctttgcagtgttcagcccccgcagctgccctcatgggctgggctagtgttgagcacctgtagcttttccacaatgaagatgcaagatgttagtgagtctatgaatctgacgtttcagaatggtgctccctgtgtggtggttccaaccctatatgttccttccatactgccctagtaaaggattcccatgaggctctgcctctttgaatagtttcgacctggacacccaggtttttctgtaaatcctctgtagtctacatgaaggattctgagcctctagtcttggcctttttgcacctgctggctcaacactatgtggaagccaccaaggcttgcagcttgcaacctctgaagcagtgacccaagatgtacctttgtatctgtcagccatggttggagctggagcttcaggtatgcagccagcagtgtcctgaggatggacacagcagcagggccatgggactggataaggaaatcattcttttctcccaggcctgggggcctgtgacagcaagggttgctgcaaaagtctctgaagtgccttcaaggcctttttatccttgtcttggctattagcactcaattccattttatgcacatttctgaaatcttcttgaactttcccacggaaaatcagcttttctttttgaccacttggccagcctgcaaattttccaaacttttaagctctccgtctcatttaaatataagtttcaccttgaggtcatttctttggtcacatataagacacctcagggtgtttggcacagaccagacacctcttgagctttgctgcctaaaagttcattccaccagatacactctaaatcatcactctcaagttcaaagtttcacagatctccaggttaacggcatcgtgcagtaacgttctttgctaagggaaaacaaaagtgaccttggctcctcatcccagcaagctcctcattttcatgtgagaccttctaagcctggccatcactgtccatcattctgtcatctttttaattataactatttaacaagtctctacactggtccaaacttttccacatcttcctgtcttcttccaacacctccaaactctccaacctctggccgttacacacttctcaacctgcttctacattttcagctatgtttgttgcagcctggcaatgtggtaaaagaagcaaagtctgtttcaggagaaaaattcaggcaggcttcagatatttgccggaaaagaagctgagtgctcattgccaagaaaataaggaaaaggccttgaaggcatttcatagctccatttcacagcactaattttctgtataatcagaaagaaaagaggttgaactggctcatggttctgcacgctttaaataaatcatagaggctactgcatctgggaggactcaggaagcctcccaatcattccagaagaccaagcaccaatagtatgttttatatggcagaagtagaaacaagacagagagaggaaaaaggtgccacaccctgttatacaaccagatttcctgagaactctctaacacaaggtcagcatcaagaatgcttaaccattggtggagccattggtgaaagatctgccccctaccacccacaacccccactgtttccaagcagaagcctgaggcagaggcagagctactaggaaaacctctactaggacaaagcagaaaaaaaacaaaaaacaaaaaaaaaggcttggtggccccacacaagaggttaccatcctccagactctctaacctctggccattacccaattcagaactggcttctacattgtcagctatctgtgtcacagcctggcaatgtggtaaaagaagaagggtccattatcaagggaaaaatcaagaaggcctccaatatttgcattaaaaaaaacagtgctaacagccaagagattgcgggaaaggcctagaaggcatttcatatcttcaccttgcagcattgattttctgtatatacataaagaaaagagatttaattgactcacagttctttgggctgtaaagaaagcatagttgtttctgcttctaggaggactcaggaagcctcacaaccataccagaaggccaagcggcaatgaagtgtttcatatagcaggagcagaagcacgacagcgagaggaaagaggtgccatatcctgttatgcaacttgacctcatgagagctcactatgaggagatcagcatcacaaagacgatgcttaactattggtgaaggatctgccccccaccccatatccacccctcactgtctccatgcagaagcctgagacagaggcagagcctcttggaaaacctctactagggcagcgcagaaggaaaatatgggtttggagcccctatgcaggaggccaccatcctccagaccccagattcatagatgcaccaacagcccgcaccctcagtatggaaaagctacacacactaaacaccagcctagcccatgagagcagccatgggggctaaagccacaggtgcactgccctagtagaggtttcccatgagcctctgcctctgcagcaggctactcccctcccacaacatgccaccctcacaccaccctacagccaacctactcctccccacctaacccacctctttgtacttccaaccccacccctctcccatccatgaataaatcacctcccaccaggccccacctgcaacattcaggattacaattccacatgagtttaggtagggatacacagctaaaccatattattctgaccctgatcccctgaatatcatatccttctcacagagtaaaatacaatcacgccttttcaaaagttgctgaaagtcttaagtcatttcaacattaactcaaatgtaaaaagttcaacgtctcacctgagaaaaggctacagtcccttttgcctatgagtccctgaatttaaaagggagttcttttctttcaaggtatgatgatggtagaggcattgggcaagttttctcaatccaaagggtttgagattgccaggaaaataacacaaatgagatgacagggccaacacaagtccaaaacccagaaggccagtatccattcaatctcacagctccaaaaccatcacgagaactcaccatcgtgaggaaaacattaaggagacagtgtttaaccatttgtgagggatcctgcctccaaccctacctttcacccctcacctccaccaaaatccacccattctccccaatccccaccttccaacacctactgccctccatgattaaatcaccttcaacttggccccacttttaagatttccaattaaaattccagataagtttctgtaacacacagccaaatcttatcattctgtccctgcctacccagatttcatgtccttctcactttgcaaaatgaaatgatgcattacctgccatttccccaagccactatgctttttttacagcctgcagaactataagccaattaaacccctttttgttatgaacacacaaaaaattagtactgtgaagttaagctatgaaatgccttcagtgacttttccccatcgtcttggataagacccccaaggtcttaactcattccagcatttactcaaatgtctgaagcccaaagtctcaactgagacaaagctgcagtctcttctgcccctgagcctctgaaatacaaagcaggttaaccacttccaaggtacgattgtccaggcatttagtaagaatctccacccaaaaggaagatttttgccagagagaagaacaaaacacaaacaggacttacaagtcccacaaaattctgaaactcagcaggccacttattcaaacctacagctccaaagtcatcctttttaaatccttgtcccacatccagggcacaagggcatgagggtgggctcccaaggccttgggcagctctgcacctgtggctttgcagtgttcagcccccgcagctgccctcatgggctgtgctggtgttgagtgcctggagtttttaacccatggagggtacgaagcttttgatgggtctatgaatctggggtctgcacgatggtggcctccagtgtgggggctccaacctcatattttccttctgcactgcccaagtagaggtttcccatgagactctgcttttttggcagccttctgtctggacaccaggcattttcatacatcttctgaaatatatatggaggctcccaagtctctagactagtgctccgtgcacccactggcttaacactatgtagaagcaaccaaggcctatagcttgcaccctctgaggcagtgacccaagctgtacctgtacatctttcagccaaggtcggagcaggagctggggctgctgggatgcaggcagcagtgtcctgaggctacacacagcagcagggccatggggctggcccaggaaaccattcttctctcctaggtcccaaggcccctgacagcaagggctgctgcaaacatctctgaaatgcctccaagccttttccccacaattgtcttggctattagcactggcctccattttatgcaaatttctggagacttcatgaattttccccctgaaaatcagcttttctctttgaccatctggccaggctgcaaatgtttcaaacttttgagctctgcttatcatttaaatataagttccaacttgaggtcatttccttggtcacacataacagcacagactgtttgatgcagacaggatccctcttgtgctatggtgcctagaagttcatttcaccagatatgcactaaatcatcaccctcaagttcaaagtttcacagatctcaagggcaaggtcgccctgcagccacgttctttgctacagcaaaacaaaagtaaccatggctcctgttcccagtaagttcctcattttcatctgagaccttgtaagcctggccttccctggccttccttctgtcagcattctaatcaaaactatttaacaagtctctacaatggtcccaactttccctcatcttcctgtcttttttcaagctctccaaactctccaacttctggtgttaccgacttctgaaccgctttacattttcagctatctttgttgcagcctggcactcctgcctttcacctgtaaccccaaacacaatcccccctaactctccccaccctcccaataccctccaactgtccccttcccacacatccaacctccactctccaccaggggaaacttcaagaaggcttcagatatttgcattaaaaagaagcccagtgctaacagccaagacaatggggaaaagtccttgaagatatttcatagctccactttgcagtacttattttctgtgtggtcataatgaaaaggggattcattggctcatgggtcttcaggctgtaaagaaagcatggtggcttctgcttctgggaagactcaggaagcctcccaatcatatcagaaggaaagcagcaatgaaatgtttcatacggcaggagtaggagcaagactcacagaggaaagaggtgccacagcctgttatacaaccagatctcatgagaactcactatcactaagtcagcatcaagaagatggtgcttaaccattggtgaaggatccaccccccaacacacctccaccccctactgtttccagacagaagcctgctgcagaggcagagcctcttggaaatcctgttctgtggcagtgcagaaggaaaacaagggctttgagtcgctctgcaggaagccgccatcctctagaccccagattcgtagacctaccaacagttcacaccctcagtttggaaaagtgatagacactcaataccagcccagcccataagggcagccatgggggctaaagcctgcaaagccacaggtgcactgccctggtagaggttttccatgagcctctacctctgcagcaggctactcccccttcctactacccaccaccctcccacaaccctacagccggcctactgttccccaccctacccaccccttttttcttccacccccacacctcccatccatgattaaataatctcccaccaggccccacctccaacatttgggattaaaattccatgtgagtttttctagaggcacacaaccaaatcatattatgctgaccttgacccccccaaatcccatgtccttctcacacagtaaaatacaatcacatcttttcaaaagtttccaaaagccttaactcatttccacactaactcaaatgtgaaaagttaaaagtctcatctgagatcaggctacagtctcttctgcctatgaggccctgaagttaaaagggcattcatttctttctaggtacaatgatggtacaggtattgggtaagttttctcaatccaaagggaagaaatttccaagaaaaataacacaagtgggaccacaggcccaatgcacatccaaaacccagcaggacactgttcattcaatctcacagctccaaaatcatgaatagaactcactctcagaagggcagcattaaggagatggtgtttacccatttgtgaaggatccacccccactcctgccttttacccataaacccaaacacaatccccccaactctccccaccccctcaataccctccaactctccccatccctcccatccaacctccactctccaccatgattaaatcaccttccaccagcccccacctttaacattccccattaaaattccacatgagttttgggagaggtacagagccaaatcatattactctgtcctgggtcccccaaatctcatgtctttctcacattgcaaaatacaatgatgccttccctacagtcccccaaatcttaactcattacagcatttactcaaatatccaaagcccaaagtcttatctgagacaagtctacagtcccttctgccatgagtctgtgaattataaaacaacttaactacttccaagctacaatgattgtacaggcaatgggtaagcattctcaaccaatagaaaaaaaaattgctggaaagaagcacaaaacacagatgggattcataggatacataaatgtccaaaacccagcaggccagtcactcaatcctacagctccagaatcatcctttttgaatccctgtcccacatccatggcacaggggtatgagggctggtcttcctaggccttgggcagatctgcacctgtggctttgcagtgttcagcccctgtagctgccgtcatggacagggctggtgttgagtgcctgtagcttttccatactgagggtgcaagctgtttgtgggtctatgaatctggggtttggagaatgatgcctccctgtatgggggcctgtgacagcaagggctgctgcagaggactgtgaaatgccttcgaggcctctttcccattgtcttggctatttgcactgggcttctttttatgcagatactctaagcctccttgaattttcccccggaaaatcagcttttctttttgaccacttggccaggctgcagattttccaaactttaggtctccacttctcatttcaatagaagttccaacttgaagtcatttcttaggtcacgcataagaacacaggctattcaatgcagacaggacacctcgctaggctgcctagatgttcattccaccagatacatcctaaatcatcacccccaaattcatagtttcatagatgtccagggcagggtcaccgtgcagccacgttctttgctaaggccaatcaaatgtaaccatggctcctgttcacaggaaattcctaatcttcatctgagaccttttaagtctgaacttcagtgtttatccttctgtcagccttctgatcgcaagtatttaacaattctctacagtggtcaaattttcctcatcttgctgtcttccaagctttcccaactctcctgacctctgtcttttacccacttctgaacctggttctacattgtcagctatctttatcacaacctggccgtgtggtaaaagaagaaaagtccactttcaggggcaaaattcatgaaggctccagatatttgcatgaaaagaagctgagtgctggttgccaagaaaaggggaaagggccttgaaggcacttcatagctccacttcatagcactaattttctgtatgatcataaagaaaagaggtttaattggctcatggttcagcaggctgtaaaggaggcagagtggcttctgcttctgggacgtctcagggagcctcacaaccataccagaaggccaaggggcaaggagatgtttcatatggctggaatagaagcaagactgagagaggaaagaggtgccacaccttgttatataaccagatctcataagaactcactgttactaggtcagcatcaagaagatgttgcttaaccattggtgaaggatctgcctcccacccccatctcccactgtttccaggcagcagcctgctgcagacgcagagttcttgggaaacctctactagggcagtgcagaaggaaaatacggacttggagcccccacacagggctaccaccctacagaccccagatttagagacccaccaacagcttgcaccctcagtgtggaaaagctacaggcactgaacactagtccagtccatgagagcatccatgggggctcaaacctgcaaagccacaggtgcactgccctagtaatggttttacatgaggctctgcctctgcagcacgctactcccccttcctactacccacgaccctcccaccaccctacagccagcctactcattcccaccctacccacccctttttccatccacacccacccctgctcatccatgattaaatcacttcctccctctccctcatctttctgtcatgctctaatccctccaaaccctcccaatctttgtttgctacccactactgagcctgcttctactttttcaggtatctctatagcaggttggctatgtagcaataacacaaaaccccatttaaggggaaaaattcaagaagacttcagaaatttgcatataaagaagccctgtgctaatagccaagacaaagggaaaaaaggccttgaagacatgcacagctctctcggcagttctaattttctctattattgtaaatgaaagaggtttaattgaatcatggttttgcaagctgtgaaggaagcatagtgtcttccgtttctgggaggaatcaagaagcctcctaattataccaaaagccaagacaatgagatacctcctaaggcaggagtaggaggaagacagagtgaggaaagaggttccacagccttttaaacaaccagatctcatgagaactcactcgctatcaggaggacagcatcaaggtgatggtcctttatcattcgtggagaacctacccgcacccttttataactaaatctttttccacctaggccccacctctaacattagggagtataattccacatgggttttgatacggacacagagacaaaccatattattctgtccctgatcccatgaatatcatgtccttctcacattgcaaaatacaatcatgccttgccagaatgagtcttaactcatttcagcattaactcaaacttacaaagtccaaaatctcatctgagtcaaggctacggtctctttttcctatgagcctctgaattaaaaagcaagctcacagcttctaacgtataatgatggtacaggcattgtgtaagctttccatattcaaaaggaagaccttttccagaaagcttcttatttctatctgagacctcctcagcctggccttcactatccatgtttgtgccaggatttttatcacaaccatttaaccagtctctaagatagtccaaaaattttctcatctgtcttcttttgagacttccaaactcttccaacctctgcccattacctagttccaaagctgcttccacattttcaggtatctttatagcaatgctgcaatcgtcatttgccattttctgtttgattcattttgaaaaagaggtttaattggctcatggttctgcagggtggacaggaagcacagggcttctgattctgggaggcctcagaaatctttcaatctttgtacaaggcaaagaaagagtgagttgtctcacatggcaagaggaaaacacgcagagtagggaggtgacatagttttcagtggccagatctcacgagaagtcactcatgattgtgaggatggtacaaggggatggtgctgaaccattcatgagaaatttgccttcataaatcaattgccttataccaggatccaccttccacattaggaaatataattaaatatgagatttggtggggacacatattcgaattgcatcatcagtctttgagtataaagacatgcacagcaggctttatccagccaacttatttgggactctttatagggtttgtggtctacagcatatacactaaaatattcatacttcaaagagcagtaaagtggtattatcattcttccaaaagtcccaatggtagtttaggcattcatggcatgatttagttcatgtttgctactgtttctattctgtcaacatattaactgtttcctacacaattctgtattcagctggatttcagttgagcacaaaaccatccttgtgctaccacggatagctggcactagctccttgctagtgttattattctgtgtagaaagtatccttgaactggaaacagtccacaatcaaatatctagtcattcaacattatcaattcctggatgatttttgaaaaaatagtatctcttgttgcaagaaatgctgcatctgtgatttcatgtctctcattcaaattggatggaagtggtgaatttccactgaagtggtgaaagaattcctgttcctgtgattctggtgtcatcagcctctgcatctctatcttcccttctgccacatgttgcctgtcctccgcgactttggtaagaacttgcttgtgtatgtggatgatgttcaggatgttggtctggtgtccctgagacagcactaacaggtccatgactgggtccaggttctgcctgggatgattggcaaagagctcactgacagtgttgaaggcatctgtggtgaagtggatgggctggtccagctccaaggcctggctgaggctgaagaactggcagccttctgatgctccttcttaaagcctgtcaccatcacctgcttgcatgtcaactcattggctgtgaagttgagccgagtgccctgttgttcatcttcttggtgaagcatttgaagctgtcaatcttgctctcccactcctaaagtttgagtgtcaccctggaggtgggctcagagccagggagaatctggcactcaccatctcatccttctcagcattcctcttgccctgtctccaggctgtctcttcagtgctggtgtggcacatcaggaagtgatggaagatgtggcactgtgcctgcacccagaagctggccatgtggttcatccaccagattgggccctttctgcacttgaacatagaatcctcctcaagagggcctgtggtctgcctcttggcacccaagaagcccacagtgctgtaggagccctgatgcatggattggagccccaaaggcagcgcaaaccctgctcctgaggctgctgctcatttcctctatgtggctccatttgcagcacagttgttgaactgaggcttgtgcatgccaggcaaggccaagttggctcaaagagcaaccagccacctctgcaagggtgtaccaggagcaggtggaccagccaccaacctcacttgctgccaatcggggtaaatcagttattctgccctggaggtagggccccagtgccatctgcttttcctcaggcctccacttcatcagctgtcaggtggtggtcactcagggtgtgggaacctggccatccctgtttccttgagtgggtgaggttggtggctggtccacctgctcctggcacacccttgcagaggtggctggttgctctttgagccagcttggacttacttggcatgcacaggccccgggtactgacaagctgctccgagtgagcttgtcttgtcttgggccaaattctaactctggccagggccacagaaggctgagtcccctgggtggtaatcctggctgctgcagggaggcccatggtgctcctcccctcccagggctcaggatgaggttcaactaggacaggaccctttaggtatgggacttgtgccccaggagggggcctctgtcacacaggttgggtaagatgtatggcatgctgctggcttccagggctgttgggatgacacattcacccttccctccagggacctcaaaatgaccagcttcccctttgagaatgacttcccaaggcctaggagccatctggggctgcagggcagctggctgcatgctgccctggcttcttccatgtcgtgctggtcactacccaccaaggggggtcagatgcaggcaccatgcagggcagttgtctctggacctgcgtctttgttatcatggagctggactgggcctgggtgagagggcctgatggggttgtcctgggtaatcacgggggtgatcagaaaagatgcagaatggaattgctgcgaggatgaacgagatgactgtcagcacagaataggcagccggtgagtgttcagggattaccctcagtagctgctcagaggccaaaaccacccaactgatagcgactgtccccaagctaggagcaagagaagagagcaggtcccactcacctgagtctgatcagtcagctgtgttgagatgtgcctctcacctagaaaacggtccttcacgcagagccactcagacaccacagtgtgtctctaactgctccacaacacagaggcgatgggggctcagcaacagtgacattgtggggtgacacaacccaccacaatgggagcctgcatgggtcaacagcgcccagagtcagtgtcctctatcccctgaactgacatgtgtggatgcagtgtgtttgtgcatgcgtgtgtgcctgtgtgtgtgtgtgcacatatgtgtgtgtgtgtttctcttgcttctctggccaggcctagcttctccactcacaggtgcacccaggtcatcaccgagggctcatggccagcattagagcttctacaggtgctccccaatctctgccttccccacccatggtggtcctggggatgcagagagaggaggggcaccaggcacagcagagagggctgggaccccctctaggtggcacacaggtcatgtgtaaagttgtaggtctgccaagtggtgctggattcaacacatcttctcaccttctctttccagccaccctccaaggtgccctgactcaccttccctgcagatggaggcaaggagactccacagacaaaccccctgcctgaggtcacacagtggccagctggccaggttcctactgaccagccgcccaggaccagtttcccactgatgaggcctctaatgaccactcctccatttaccagttcccactgaccaagtccccactgaccatgtcttcctaaccaggctcacacttaataggcctcataggccagacctcactgaccaatttcccactgacctggtccccactgaccaggttcccactgacaagaccacagttgaccaagtcgctgctcacctgacccccactaaacaattttccatggatcagtccccagctgaccgagccccctctgaccagaccctcactgacgaggctccaagccactaaggccccacactgaccaggcccctagtatactgcataggccccaccagtttttcattgtttatgttccagcccatcaggcctcactaagaagaccatcagtgaccaggtccccatgaaccgggcttccaatgactaggtcaccaggtccccactgaggaggcctttactgaggaggccaccactaaccaggtcccaactgactaggtcctaatgaccaggtcatctctgagcatggtccactgaccaggcccctgagcagcgtgctcaaagtctcattacaatgcccccctcagcccacagaccctccctccctgtatgtgtgtccagaggtcaggccctggggttttttttgggacatggcttttcctccaagacagagggagagacagctggcctcaggctccaggtgcccagctccacactcaccccaaaagccctctgggccaatctcaaaggagatagtgaggtggcctggcactgcctggacatgccatgtagcctattcctgagtgtcagagtgggaggaaggcagggacatttggcagatgagacatcttgtgctgttgggcatcccagggcccttcccacagagtcccgatctacagacacagcacagaggctacaggaagactaatgcaggacccttgaggctgagccagggaccacatgaggactgtgcccagacagccagaaggccctttgctagtttcttggtacctcatggatgtggcagcggttgttctgttggggaccagtgagcacgtgctggggagggctcgcctgtgcttcctcagtggctccacctctgcttctaagaaaaatcactcattccatggctggagcagagaaaatacaacattagcttagaacatcttgttcctgaaactaaaaaagtgctgacagagtaacgaagacaaataaaaaagacaagaagtcagcttgaaatgtctaccactggcctaatcttggggaattggagcaccagaatcatgagctttcccttctcagttatttattggttttacttctccaggtacagcaaagaagagaagaaaataatcatctggcaaccatcatagtaataattgttcaaacacaagtcatccatgaaatgctaaatctagtgggttctgggagtaactggatatttacagagcctcaaagtatctccccacaaaatacggttcaactacaaaaagaaaattgtcacattagcatgcacaagcctggcaggtactccttaactcccctaagtagtaaaagctgtaaaatgcaaagaagccttcgatgacctttactaaagtatcaatgatgacttcgttctttggctgtttaaacagctggcatttgggcaatttgagtacgtcaaactcaataatactggtgttcatttgcaagatccacttaaaacttaaggaggctaaaaaacatcatttaaattaccctataaattatcatcacacatgtgatacaaaaacatcctacttcagtaaagattgtaatgttatatattttatgagaaacaattaaaatgttgtgtaaacagcccagtaataaagttttataatcttttaaataataaaatttttccttaagactttatggttaaacattctcttcattagatgtggcttaccagtggattatagagaagtaagtagacgggagcaagtgttcaacacagcaacaactggaaagagaaagaattatgttctttacctaaaacacttcagttaactaaatgtgagtttaaatactaaagagttgagaactttatcagagttagtaagaatgagaaatatctatgtacatttacaatacaaaattactattaaataatttacacatggcattaattctattgtgtttaaatattagaggtttttcattcttcattcatgtaatcaacagccacgtgctaaggtactagaaccagcactggaattccaagatgaagatggcatggtccacctcccaatagtcatatgctataacctaaaaacacagacaggtaggcaatgtccacatagtgtcatagataccatgacaggtatacagcagggcactactggaacacacaaaagggacatctatcccacttttatgtcaatatcatgggctttctggtggaggagataacataggttgatacctgaaggacaaggaaaagcttgccagatagagggaagaggcgaaggcaaagagcctgaggtgaggaagagccctgcggagttctactctcctccactttggtgctagagcaaagggtagagtgcggtaagtggcaaaaaacaaggctgagtaacttgacaagaatcacattgacgtgggtgtttttatttcatggtgaaaaatttggaacttttcctgagaacagatgtaagccaatgacacagtatatgataggagatttaaaatgtcacctgtcaagtgactgcttatgaagggttattgcccagctaagaatttcaaaatgagtctgaggtctgttggccttcaatctgtaccaaaaccctgagaacttggtgatgcctttgttttctgagaatcgtttcagtgtgctggctgacagttccatgatgatggcaaaacttaagaaagtgtagagccagtaaaaaacagatgcacagacttcttgggaattttttaagctatggaacatgatgaatttatagtgcataagtacagtcttctctgtgaaagtttttgttttcacatcttgcattagatgtgtgtaagaaaaaaaatacttgacatagtatctactaaccaaacaatgaaaaggaatgccatttgttatttacacttaatttctaaaataaacctaaatgtaattaataaattttggcaacatacttctctttgtttctctagttatttgttctacacagtccagctccatctaaaataagtaaaaataataataatgtttaagttaaacaagaaacattatcatgcaaataatgtatcacttacaaaatgtgacctttagtatttttagtgactagacataacttgaagtttgcttaaatagaaaaataatcacataaataaagtaaaatttctacttattttaagtttagataacagaggatgcacctgtgtaatgctgtttagagtaatcagacaaaaatacagttaatattggtctactgcatatacatgattttagaaaggtagtgttttattagtacaaaggttaaacaatggccaggtgtggtgactcatgcctgtaatcccagcacttggggaggccaaggcaggcagatcatgaggtcaggagatcgagaccatcctggccaacatggggaaactctgtctctattaaaaatacaaaaattagctgggcatggtggtgcacacttgtagtcccagctactcaggaggctaaggcaggagaattgcttgaagccaggaggtggaggttgcagtgagccaagattgcaccactgcactccagcctggtgatacagtgagaccttgtctcaaaaaaaaaaaaaaaattaaataattaaagtcatcttttcaatgaatgcattgctttgaaattcttagcaaaactctgccctttatacaagtttaatccaatttttttacatcaataaattttatcttaaaaagaaatttctattctctacttatagtaaacttttttaatagtaaatttttcttgttttttttttgtttgtttttttctagtttgtattctaaattaaggtggtacctgtgtaggcttcttccaagagaatattgagggatgccaaggtttagagtacagtggaacccatcacacaggtagtaagcataggacccaataagtagttttccaaccctggcccactctgtccctccctgttcttatttcccagtgtctattgttcccaggtttatgacaatgtgcacccaatgtgtagctcccacataagtgaaaacatgagatatttggtttctgtttctgtgttagtttgcttaggatagtggattccagctgtatccatgttgctgcaaaggacatgattttgttcttttcttggctgcatagtattccatggtatgtatggaacattccaatctaccttggattttcaatctgccttggatgcacctggattgactccatgtctttgctgctttgaatagtgctgcaatgaacacacatgtgcaagcatctttttattacaatgatttattgtcctttaggtatacccctagtatagtaatgggattgctgcatccaacggtcatccttagttcttaatttccaaactgctctccatagtagctgaattaatttacattgccacaaacggtgtgtgttcccttttctccactgcttccccaacatctttttttttttctttttacttttcaacaaaagttattctgactggtgtgaaatagtatctcactgatgttttgtttggcacttttctgatgattaacaatggtaagcatttgttaatatgtttgttggccacttacatgtgttattttgagaagtgtctgttcacgtcctttgcccatttttaatggtgttatttattttttgcttgttgatttgtttagatctcttatggattctggataataggcgtttgctgtatccatagtttgtgaatattttcttccattctctatgctgtctgtttaatcccgtgatagtttctcatgctgtgcagaagctctttagcttaattagatcatacttgtcaatttttgttattcttgcaattgcttttgaggactttgccataaattaattgagaagtatgaagtccagaagagtatttcctaggttttcttccaggatttttatagtcagaggatgtactcttatgtaagaaaagcacaaaccttttttttttttttttgagacagagtctccatatagtgcagtggtatgatcttggttcactgcaacctctgtctcccgggttcaagtgactctcccgcctcagcctcccaagtatctgagattacacatgcctgccaacatgccttgctaatttttgtatttttagtagagttgggtttcatcatgttggccaggctggtctcaaactcctgacctcaggtgatccacctgcctcggcctcccaaaatgttgggattgtaagtgtgagccacggcacctggccaagcacaaagctttgaacataaaaatggaaatgaacattttagtgttttgtttaattcataaaatgcaattattttggattctactaaataataaacatctatatgtggtaaactgtttggatgccaatcattcagttgtgattatgggtgggaagagttgagatggtgcaaataaacttttttttaaattttttatattcaagatgaagtctcaccctgtcactcaggctggagttcagtggcacgatctcggctcactgcaacctccgcctcctgggttcaagcaattctctgcctcagcctccctagtagctgggattacaggtgctctccaccacacctggctaattttttttttctactttttgtactttcaccatcttggccaggctggtcttgaactcctgacattgtgacacacctgcctcagcctcccgaagtgctgggattacagacatgagccaccacacctggctggtgcaaagaaactttaaaagtgacatgggctggacgtggtagctcatgcctgttatcccagcactttgggaggctgaggcaggcagatcacaaggtcaggagtttgagaacagcctggccaatatggtgaaaccctgtctctactaaaaatacaaacattagctgggtgtaatggcaggtgcctgtagtctcagctacttgggaggctgaggcaggaaaatcgcttgaacctgggaggtggaggttgcagtgagccaagatggtgccacaacactccagcctgggcaatagagtgaaacactgtctcaatttaaaaaaaagggggggcagtatgaaccacagctaaactataatcaattagagagtaagccaaagcatctcaaactatatcatcagttatcaggcaataatatgcaatttctaaaacctaacttaaatgcagcttttaaagacattttaaatgtgtcagtttagtcacatttatggaataaagttagtaaacgggtatctcttgaaaatgagagctccagggaattaaaaaatgtaaagttcccatttcctttctgtgttaacacagctaattatgatctttacaaaacatgcataagtcaacagaattcagtatttcaccaaattaaaaacaagaattatattagagaaatgaaacccaaaagagaaatggtcatgtaactaaccacagtctaggagttcttgcagttatttgaagtctgtgggcttgaaataggaattcttatgggtgtttggggaatatattttctgttgagtcctatactagtaagattttcaacacaaggtgactctgggtctcgccttgtaggaagagcactgagaaaatatttcatctgctctttctccataaggagcttcatgctgatcactgctattttcttatttgatctgtaaagatagcaaagacacacgcttagtatttcatttttcctctaatgattcttaatgacttgcagtttttaaaaacttgccctgagagcaaaccaaattatccactaaacagtgttttcacactgaagatgtgtgagagcatacctgttgtaagcaagtataattttaaaatcattctaaagaagcacctgtgtttctaaggtgatttatactgaacaagcagtacaaacaaagtagacagggaagagaaatggctatcagtgatatatggcttgacaggtaacacttgctgccttctaaaagggctctacttgtgagattctgaagattccattagaaatactcatatttaaagggtaacaatgtgagaaaagaatatgttgatttgcttgattataagaaccacttcactagaaataattgtatcaaaacatcatgttgtactccttaatgtaggttaagaaaactaaaatgaacaacaacaaaaaaatttaggaatacttgtgtttagcaaacaaattttaggtttcacccttgtgcatttcacccattatctaggaacaattaagcatttggcactgaggaataattcagaacaacaactcctgggggagaactagattggctggttggtgatcaaaaagaactaaagcatgtctgaaggcaattagcgcccagcactgtgaccaaggcactggaggtggggctttttccttctgccttccacacaccccttcaggctgaacaagtttttttttttttatactttaagttttagggtacatgtgcacaacgtgcaggttagttacatatgtatacctgtgccatgttggtgtgctgcacccagtaactcatcatttaacattaggtatatctccaaatgttatccctcccccatccccccaccccacgacaggccccggtgtgtgatgttccccccttcctgtgtccatgtgttctcattgttcaattcccacctatgagtgagaacatacagtgtttggttttttgtccttgcgatagtttgctgagaatgatggtttccagctccatccatgtccctacaaaggacatgaactcattatttgttatggctgcatagtattccatggtgtatatgtgcgacatttccttaatccagtctatcattgttggatatttgtgttgcttccaagtctttgctattgtgaatagtgctgcaataaacatacgtgtgcatgtgtctttatagcagcatggtttataatcctttgggtatacacccagtaatgggattgctgggtcaaatggtatttctagttatgttttaaccactttgtgaattacacttctttaaattccttgataattattccctatttcacaaggatgcctttctgtaacatcttgaaaatgttacacaaatagtctttcttgaggcacgctctagtgataatactaaagatcacaatcaaaaatgattgtgcccggagtagcagtaccacttgaaactttgggtttaggttgtgatctaccaaaaaataaattaaactcattaatatttctatttaggaaaattctgacaagcaattttataacaagatcacattattaattataaagcttcgaaagtacttagtgacaaaaactaacagatcaggttaactacatgagacttttcaggggaaaaaagccatacaaaagcaaaaaaaaaaagagagagagagagaaagaaatgggacagaaactatccttgactaacattttaaaggtaagattatttactaacattattttctgaaattacattattagattagcattcacttcctactaatctcctgaagccatctcactaaaaattatgctttcaaaacaaattaatgagcttaattcattttctatgagtgtatgttttgacttactttgttaatttttttgacatggaattgttagctttcaatgctgctgcaaaggcttccttatattcttctaattcggttgtaacctcttcataagcagttttcatttctgagaatttacattccacatctttaagtgtgagttcctttttatttagtgaagccatattatccttgtttaactgctctaattgtttttcatattgtgcttgttcctaaaacaaaggaaaagaatacacttttaaaacaattataacctaattattatatgtttgttgcctttcattttgagtcagtgattcaaagagcaattgtgaatatgttagtaaaagaggctgaagcttaaaatatttatcagcaagttcaaaactaataactgaattcagaattgtctgatttataaaaatttgaaatcataattatgttagtattaatgtaatctggtcatataaaaagtaatagaatccattcataattttaaaaagtgattaatgaacaatgtagcttaagaccaattcaaaagtatcacataattttgaaatcacaattgtttcttatgccaactgatcttaatcatcaaatgactccacagtgagaatcattactctgaaagattgattttgttataataataatggaaatgtaaatatttaaaagaaaaaacagatgccattttttttctagaactctacaaagcaaattgctacaagagaggcagaggaaacataatatatacatatccaaaatataatttgcggtgaaataaatgaaagcacattacagataaacttacctgatttaaaaaactaacctgtaaatggatttcttctaatttttctactgcctgcactgccttttcatctagctccaatttatattcttgtagtttactaagttctaccctattgttttccatatgtgtcttaagatttaatatttcttctttcaacatctttttatcctcctcaagtttctcacattgctgttgtacttttttcatagataaaaactcctgttgaagaacttgattgtctttagccaaattgacacattttgaagataaagcttccttctctgccgtaagatcatcaaactgcatgaataaaataatatagcttgataatgaagtaggctgagaataatctaatacaaaaccaatagcaaattttgaaatgcatttacttgcaataaaatgttatccgtaatgcagtggattcttcaaatgtgaacccttaaattactcagaattttaagaacaaagttaaagctaccatgagtcacaaaaatatattatttgctatcatcatctttgccacagaatttttgcacttcatcttacttttatttttctgataattcatttttgttcctccttagatggcactaagttatctcttagtaaaaagtgtctaaccaccttccctcattatcattccccataatatgtcaaaaaaaagtttcagagatatcatattgagttatttaggccaaagtcaataaatggctctcagaataagactttgaaaataatataacactctatactaggcatggtggctcattcctgtaattgtagcaatttaaaagcctgtgccagaatgatcacttgaggccagaatttgagatcagccagagcaacatagtgagacccccatgtctacaaaattttttttttaaattagcttggcatggtggctcatgcctctagacccagctagttgggagactgaggcaaaaggatggcttgtacccagagttcagggctgcagtgaattatgaccacatcaccgcacttctgcctggatgacagacaaagaccatatctcaaaaaaacacaaaataatgaatcctgtaaataaggattctgatgccataagcctttccttaaactgcaaatgtttcatgctaatttgaattgcattttacgaagtaatgattcttggggtaaaggccatagaatacacacccagaaataaatccacatatttacagccaactgattttggacaaaggtgccaagaacatacactgggggaaggacagtctcttcaaatgaatggcactgggaaaactaaatatccatatggagaagaatgatactagcttcctatgtaacagcacataatgaaataaactcagaattgattgaagactgacatttaaggcctaaaattatgaaaccactctaagtaaatggaggaaaaatgcttgaggacattagtctgcacaaagatttttatgggtaagacatcagaagcataggcaaaaaccaaatgatagacaaatggtattacattaagataaagagcttctgcccagcaaactgagtgaagagaaaaccagtggaatgggagaaaatattgtcaactattcatctaataagggactagtatccaaaatatacaagaaactcaaaaaacttgacagtaaaaaaaaatctgggttcaaaattgggcaaaatatctaactatacttttctttagaaaaaagaaatacaaatagccaataaataaatttaaaaacgctcagtatcactaatcctcagggaaataaaaatcaaatcttcaatgtgatacaatcttgcttcaatttgaataaattgctatcattgaaaagacaaaaaaataacatatgctggtgaggttccagagaacagtaaactctaacatgctgttggtgggaaggtaaattagtgcagccactatagaaaacaacatgaggttttctcaaaaagctaataatgggactgccaagggatccggcaaacccactattgggtattcaggcaatagaaaagaaaacaatagatcaaaaagatacctgtactcgtatgtttattgtagcactattcacaatagctgatgtatggaatcaacctgcatgtccataaccaaatgaatggacaaaaaactgtggcacacaaacacagtagaatactattcaccgtataaaggaattcaatcctgttattcgtggccatgtggatcagtctgagggatggtatgttaagtgcagacacagaaagataaacactgcacattctcactcatatgtgggagctaaagaaaaactgagggctgggcaacatggctattgcctgtaatttcctagcactttgaaagaccaaggcaggagaatcacttgaggccaaagttccagagcaccctggacaacataggtagatagctctacaaagtcaaaaatcagacaggtgcaatggtgcatgcccataatcctagctgctcaggagggtgaggtcagaggatcacatgagcccaagagtttgaggctgcagtgagctatgatcaagccactgtctctagtctgggtgactacagatgcccagagcccagactggactagcaaggccctgtctcttaacaacaacaaaaaagctcacagaggtaggggaggggaggatggttaatggataccgaattacagttagataagaggaatgagttctggtgttctgtggcattgtagggtgaatatggttaactatgatttattgtatatttttaaaaaggcagaagattttgaatgttcacaattcaaaaaatgaaaaatggttgaagtagtaaatgtgctagttagctcgatcattacacactatatacatgtatcaaaatatcactctattggccaaaattatgtatatacatgtcaattaaaacaaaagagaagctatatttatcccattaaaaaaacagaatatgggcaatccttactgacttccttctaatgaatagaatgcagtaaaagggatatcatgtggcttccctatctcagactgctttccctttgaactcagcccccagattgtgagtgagatcaggccagagagacagcctgggagtgtcagtgtcaatattcatgctgcctgctccaaccaaggttccagccaatggccagcatcaaccatcaaacacatgggtgagcaaagcttcagaggattccatttccccaactgatcagctattcctagggaagctgaggggagcagagatgacctgtcctggctaagcttttttcaaaccataggttcatgaacaaaataaatgtttttcttttaagccacaaaaacctggataattgttagaaaaataagttttaaaaagagacaacaggaaacataacttatgcagagaaaagagtctcctttaaagtaggatctaataaatgttgagattaatttattgatggcaaacattattgagaagcagtagataaccaggagagagacataagctgctgaggaggaacatttcctaaaacccccttcaattatgaactctgataacaaggcaagggtgtctccttacaatttcccctcaagttaggaaataagactgcaaagaaagaagaagtatgatttgaaaaacaactagaaatacttggttagataaccaaaatcagacatttgcctgatttcagttaatgaaaattctaaaagaataagctttgagtatttattaatcaatctagtattcaattttcattttccttttctcaatgaggaaataaggagaacattatggaatgatttttagtcttcacagaagtaaaataagcacaatatgctttgagtgttaagacatcaaatgcaatttctcctttatcttacttcaagcttgtttgtatggagaagttaagaccatcccatctctgtattataccacaatgcttctctacagcacacaacttggctccgaaatttcaaaagtcaaaatactaatctactatttgtctctgataaattgcctgaacattacctgattttgaagtgctgcactcctaagactttttcttggaatgagttaaactttatatcccaagaatcctctactgagctagaaagcagagctgtgcatctctgtttcagtaaaaggaggtcaatacagggaactgtggtttctgagaatgcaagatctgcaccaagtaaaggattagatgcagagctacccaagagaaccagctaccaggtggaaagaggatctgcgaactacaacatgatgacttcacatgatttccactgaggaaagctggcagctcagacttctccttcctggatggtaaacatctatggaagattctatgaattataatgagttagcaaaacataatacactaaatattagactacatcagcagatcctgtgatgaaaacttactgaaaatataactatagagggaggcaatggaaaagagactaaaggtttgaatagagaaaaaaagaaagagtgtcttgtaagcctgacttgccatcatgtcttagagtaagtaaggtataagctggccagagattcctttgaggcacaaaaggtgaagttaaagatattccactaaatttaatttttattatgatataagacaactggtaatatgcaacatgcttgaaaaaatcttctcattaaattcaatttggccttggcataagaatagatataaacaaactaagaattgataatctacaaataaacctgcacatttacagtcaattgattttatacaaggttaacaaaagaacagaatgggaaaagaatagtcttttcaacaaatggtgctgcgacaactggatatccacatgcaaaaaataaataaagtacgaagaaaaccctggcataaatctttgtgactgcatttggcagtgttttcttagctatgactccaaaggaaaaatggattcaatgaacttcaaaattgaaaactgctgtgcttgagaagacagtatcaagaagtgaaaaggtaagatactgagtagaagaaagtatttgaaaagcatgtatctgataagggacttacatatgtaggatatataaagaacctttgcaattcataaataacaagataacccaatttaaaaaatgggcaaagattttgaatagatatatttgcaaagaagatataaagatggataataagcacattaatagatgcttaatgtaattagtcattaggaaaaagtaaatcaaaaccacgtgtggtatcacttcacaccacaggatgaaacctttattcaataaaaaagagaaaataagtgttaggaaaaatgtaaagaaattaaagcccttatccaatgctgctggggatgtaaagtggtgcagccactttggaaaacaaactggcagctcctcaaaaggttaagcatgaagttaccatatgacccagaaattccagtcatgagtatatactccagaaaatcaaaaacatatgcaagcacaaaaactcatacgtaaatgtttacagcagcattattaataagagtgaaaagtggaaagaaccaaaatgtccatcacctttgggtgggaaagaacccaaaggtccatcacctggtgaatggataaataaactgtttgatgtatccatacaatggaatatcactcagcaataagaagaaactaagtactgatactgtattaggaggagacagcaaaatgcctaggcagataaggaagggtccccggagaatccccaacaagcctcacaagtgtttacaccagacgttatgtgcagataagggaacctggacttgtcttgcctggacatgccggcagcagacccgaggcccacaagcactggggggatggggtggagtcaccaggaattcacgccttatgcagagcaggagcctggccgcttcagctcctgtgctcctggtattcaattgtgaggtggaaacctgtttgcaggacgcccctctttgctgagagctttcctttcacttaataaattctgtcctcctcacccttcaatgtgtctgtgtgcttaatttttcctggtcatgagagaagaaaccagattgagctgaactaaggagcaaaaaccctgcatcaatacctgctgcaacacagatgcagcatggaaaattatgctaagtgaaataagccagtcacagtagaccacttgcttttcatttcagaggcttataggcaaatctatacaaagaaggtgggtggttacctagggctgagggaggaagggaaaactagtgaagatagctaaatgatgtggggtttgcttttagggtgatgaaaatgttctacaattgattgtaatgatgactgcataactctctgaaaatactgaagttaataaattgtatattttaaatgagtgaattgcatggtgtgttcattatttctcaataaacctgttaccccccaccccaaattaatttggtactagtgattttggtagtagtgatctggagacaggtactgcttggtttcagatcactggccagggttcaaggcctaagagaatcaacagcatgtccttttcatagaaaaagagattgatattttaaaagctatccttttcattagtttcaagtctgtaaaattaaatgaaaaatctttcactgcttaaagcactgacagatttatattgaggaataagaccttgttttccttggccccaatttctatctaaagggtctgggaatcacacccttcaaactatcaaatctcatcagatgggttttattaactcttataatgtggcttcctttctaacctgattctggtgcagcatcacagagagaagaagctgaaggaaatcaaaatattttaccccaaaatatattttttgtcatattttgaaatggctgctgcagggccaagagattgaaatggtcctcattaatgtagcccaatctctccccttctaggtcttcccagatctggggaagattaactaagagcctgaggcattcaaagtctgaaaagatatatttaccctctattttctcaacatattttggcagaatttgggtttttccattatcaatattttccaaaattacatgatttttaataccaaaactgatttaaaattaccatacgttggaatataaattattctattataaagatacatgcatttgtatgttcattgcagcactattcacaacagtaaagccatggaatcaacccagatgtccatcagtgatagacgggataaagaaaatgtggtacatatacatcatggaatactatggagccataaaaatgaatgagatcatgctttttgcagggatatggatgagctcaaagctgatatcttcagcaaactaatgcaggaagaaaaaaacaaacactgcatcttctcacttagaagtgggagctgaatgatgagaacacatggactcggggaggggaacaacaaacactggggcctgttaggatcaggagggagagcatcaagatcaatagctaatgcctgcagggcttaatatctaggtgatggattgataggtgcagcaaaccaacatgacacacgtttacctatataacaaacctgcacgtctcacacatgtaatctagaccttaagataaaataatttttttaaattaccttctgttttagcttcttaatcagaatatccattttcagttgatctgtttttaagtctccatggcaatcaaagtcttcatttccaaatacatttaacatatttattgtcatttccaggagtttcttatatctgcagaaatgtacagaattagtaagtcaagtatttttaagagtaaatatttaataattgtttaaacatctgttatggcatatcaaagaaacaaatctataaactatgttactttcagtttcaactgaacatagtttgaaagcattctatatgaaattataatcttagataaataatatgaagaacaattttatggcatatatggcaggtaaagtgatattatagccatacagtgtttttgttttgttttttgttttgttttgagatggaatttcactcttgttgcccaggccaaagtgcagtggtgtggtctcagctcactgcaacctctgcctcctggactcaagtgattcacctgtctcagcctcccaagtggctgggattacaggtgtgtaccaccacgcctggctcattttgtatttttagtagagacggggtttcactggtcagactggtcttgaactcttgacctcaaatgatccacccacattggcctcccaaagtgctgggattacaggtgtgagccaccacacctggcctaaccatacactttttgtaaataaactactgatatccatgttggtatgctaagtaaaataacgtattactaaatataagccataacccagagatgagtaaccaagataaaaaagtaaaacacatacatttaaaaagacacaaaagtacattttgatacccactgaccacagtctatcagaagaaaaaaaagtacacacaaaaagcatcaaggagatcattcaatgtagaaaaagagaagaaaacatctttaatatctgagttgaggagaaaaaggatacaggcagttttagaaaaaaggaaaggggcagagagatgtgtgacgatttaaagactttgaagaagagatctagacatctttgctgacataatgtcaacaaaatgaaagagatacaaaaccatgtagagaaaagcaatgacagaaaaatgttgattctaatcagaaaaccaaattaagtgctcagtaaataaatagaaaagtagctgtgttcagggcttcaaagacagattccattgttttaaaaaaaatctgtgatcaaaacatgaatgttcattttactttttctttaagttatacgtatatttttatatatatgaaatttatttatgtaaaacaagtttaataacatgtatacttcatgtatacaacagaggtactcatgtacaatgagtaaatttccacgttttatatctaaaagaaaaagcagaaacaaaatataagctacatatcaagataaatttgatgttaaagaatgacacaaacaggtcttctttaaacaatttgaatgcagcagaggatactacaaaaggaagaaaaaatgaccacagacagcaaaaaaatatcttcagaaataaaaattcaaaccagataatgaagagtgcactggacattaaatgtccaaggcgtggtcattgttttcaaaatcattaaagaataagtggctgggcatggtggctcatgtcactttgggaggccgaggcgggcagatcacgaggtcaggaattcgagaccagcctgaccaacttggcaaaaccccgtctctaataaaaatacaaaaattagccgggtgtggtggcacatgcctgtaatgccagctactcaggaggctgaggcaggaaaattgcttggaggcataggttgcagtgagccaagaccgcgccattgtactccagtctgggaaacaaagccagactttttctcaaaaaaaaaaaaaaaaaaaaaaaaaaagaatattttggcattcaaaaaaaatttcaccttgccccagcagctcagctgactcccacccccatgacacacgtctaaaaagttgtgctgtgagtttctgaaatacattttaaaacagaattcatttaattatgaaaatgcaaacataaaatgaatttgtatctaggttttagtcaagtaaaattagagttaaatcaattaataaatggctaacatgttctacaatatgaaaaccatacccagttgcctcttcttctaattcatcatttttctttcttattcgattcacattatacttcagtgatgatattaactcaaaaagttttcttaattcttcattttcttttttaggcttaaaaaaagtgtttaaaattatttttgtaaaatctggagaccctcttttatctcaaaaatattatttctcataagtggattagtaatacgtatttatgcaggtgtataaagtgcattttataaacctgatgccaataaggtcagatttcaataatagtcacttttcttaaaactgctaaaaatgattcaaattttcatcattatcttttctgaaatttaaactgccaacaatgtttgttacaaatgagggtttttacacacaaaatactaagggttagttaaaaaaaaaaagagtagttatatttacattttagtttttaaagatgctctagaaatattgtttttaacagtttaagatattccaagttctcttaaattacatcttactaagacaaattttagaaaactcttatctagttcccattacatttttcatcctcatctgtcttcaggctgagctaaatactgtcattctaagtattcacccataggtttcagtttttccctttctcttaaccatttctctttaaataaagtttattttttctacaataaacaaaaacaactttcgtctactttttgtggcttttctattatcctgtttctccccttccattggactctatgacacatggtttcattcagaaatcttttttcatcaattattgtgttttttatactgaaatctgatttttaataattccaataaaaaagtccaacggtcatgaaggactttatcctgctttactcagcagagcagtgaccaaatgctccctctgctcctctgaccccacttcctttctaaatgcagtgacctctgttcttcagccctatccttttctggttttttgttttgtttttgttttttgttttgagatggagtctcccactgtcacccaggttggagtgcagtggcatgatctcggctcaccacaacctccacctcctggattcaagcgattctcctgcctcagcctcccaagtagctaggattacaggcatgtgctaccacacccagctaattttttgtattcttagtagagacggggtttcactatgttggtcagactggtcttgaactcctgacctcatgatctgcctgccttggcctcccaaagtgctgggattacgggtgtggccactacgcccggtggctatttagctttttaaattctctcaggactcctaaaatctcaaaactttgacctagattccctaatctacatttccagctctgacctttttcttgaggtctcttccttctagtacacatattatagacaatattctccaccacatgctcatacattgctacttggtgcagattacttttgtagatagtgaatcttgtctattttatgttggttcttattgatgttactttgagtatactgttattttctaatctcaaagggggactatctcactgttacgatactaaccagtatactttgtcctttttttcattctttcttcttttttggaccaatatactttgtccttttctttttttgagatggagtcacactgtgtcatccaggctggagtgcagtggtgccatctcagcttactgcaacttctacctcctgggttcaagtgattctcctgcctctgcctggcaagtagctgggactacaggtgcacaccaccacgcctggctaatttttgtattttcagtagagacagggtttcaccatgttggccaggctgtttttgaactcctgacctcaggtaatccacccctctcagcctcccaaagtgttgggattacagatgtgagccatggaacccagccctctttttctttgataatgaaaactttcccatgagaatcagattatcaattgtttgcctttgttttcttttaaataatttccttttccatagagatatggcatgatgaacatcttgttctaaagttccttttgggggacactcaactatgtcatcgggaagcttcagtaagtagagatctcccttcttcccattcaagattcttcatctcaaaatggtgtctaccaaatgtcttaatccaggtagtcccttgcttagaaattcatgaaataagaaccttctggagaagttagaggctattgattgagatggtttaaagctgccccttattatgtgttttactcccaaggcagacatcaaagcggctaataattctatgcctgatgtctaactcacttctatgggaatctatacaacatgatttatttatgagacagagtctccctctgctacctaggctggagtgcagtggcttgatcactgctcactgcagcctcaatattccaagctcaaacaaccctcctaccacagcctcccaatgtagctgggactacaggcatgcaccaccatgcctcagctaagtgtttaaaaaaatttttttttttttttagagacagagtctcactatattgctctggctggtctcaaactcctgggctcaagcaatcctcctgcctcagccttccaaaaccaggtgtttaaatggggactaacatgaagcacttagaagactacatggaacatagtgagctacataaaatatttgctattagcataataattttattgtatatcttaacaaaattgtgtatttacgcaggtggcatgccaatggaagtagtctcctatagctgcactgaatcattcttaacactgagagttgcagcaaatgggggacataatttataacttacttttctctctgtatgactcattaggcaatgactgtgtatgtactacaatgtaaatagcacctcctggatggaatagtacgtaactgacatgaccagcagagacaggctaaagacactgagctgaaaaccctggactctattgctaagtcaaggctcctgaatccgttccctctgagcaactgttgctgtggtgctgccttcacaagcactctgctgagcactcagattgaggggctgtgctatccttcatcagacaagctgcacccagaactgttcagctgacagactgggagcagtccagaaacacagtaatggctgcatagtgaaaaaaggccaatttatattctttttcatagagagaaaaacataaacacgtgattgaacgcatctcctgtgttagactaattgggttagatttgatatttaattgctaaaaatatatttagaatataaccttactgtgtcaaggtctcaaagaagaaataattggtatggtataaatgattgaattgtatgctacaaacttctaagctaaaatattttcaatgtatgcaaggataggtggcatacacattatatattattcccccattaagcaaatttataatgagagaaaattatcttccataaaaaaataaaagccatgtaaaattaaggactaagtttttcagcacagactagacaacgattgctaacacataaggtcaatgacagaacagtcagagaaagcttcatgaaaacaaaaaaattgtctgccaggtctgaatgaatgaggctagatgaacagaaactgagaaggcagaaagaatagcatgagcaagacaagtgctgaaatctgcccaattaactctgaggataaagtccaatggcagggaaataaaaacccgtgtccacataataacctgtaagtgaatgttcacagcagcatttttcataatagctaaaaagtggaaactaacctaaaggtccatcaactgatgaacgaatggaaaaccagtatagccatggaatagaatatcatttaactataagaagaaataaactacgaatgtgtgctaaaacatgcatgaattctgaaaacattatgctaagtgaaaaagccagtcacaaaggactacatattgtataactctatgtatatgaaatatgcagaacaggcaaacatatggagacaaaagtagacggtggttgcctacaacaggggtaggtggagggacatggaggaaggctgcagtcatgcctaggagatgtggggtcacttttcagggtgacgaaaatgctgtgaacatactaatagacactgagttgtacattttaaatggttgaactgtctgatatgtgaatgacatctcagtgaatctttttaaaatccaaaggcaggatcaagataattttctcaactcttaatttttgatgtacatgctatatcaaatctaaatatttctacagttttacagtatattttaaataaaagataaagaaaatgcctaacttttcaaatagtttgtaaattaacctaaaacatgcacatttcaaagaatagtataatggcctttctgtacaagttaacctagaatctgtgaaacaaatagacacagattctgtgtccattcacaaaagtgaagaaataagacaattttctggaacattccatgaaacattctcctctgatttaatctggcttgcctcatcagagcaatacacaaattacttaaaaatactgtttaacaggaaaaaagtcaattttctatgaggaatgatgtataattctcaacttttccaagggtacatattgtaagagaaaaggtatgcaatggtttttcaaaatggtataatgaaagtcacaatataaaaaaatagtacattataaagatagtaaaatggaaatcattcattataatgaaaataaaaaatcaagcttctgccaaaattagtatcctaaaacacgttatataattcaactagctacagaataactgttgacatgttaaattccatacatatttgacttttcacttgaaataatttcttatttgaggcctgtgtctcatccaaattaatgtgacaacgtgatataccttccagtggagactctaacgtcgttaatttttttacgctgtcagccacttcttgttgaagttgtctcacaaccacctgataaaatatttgttactgattttataaactgccttattaaattatgttaataatgtttaattctaacatatctactttgaaaattatcaccacacatatcaattcaccttcttttaatcacatgtacacatttttatttattactgaattcagtgagggatgcagaatatgttctcttcctgccaaattggtattctcttacttacacaacagattcattccaacattcaatcatctcagaagctcaactcagcctcaaagttcctaacatattcaatcacctgttcaaatccttccaacagattcctatctcagaataaaagtaaaattccaatggcctttgaggccctaggtaaaaaggcctctacctccctctctgacttcaaagctcctacaactccctcctgtaattactccattcccactgtatgtgaagcctgccacccctcagtctgaaaatggagatgtagtgcctaactcgtaaatcacagacagctacaagtatctttgtactgaacaaaattatattccaatgacagtcattgagccttgcaataaaaattatgagctaattattaatataaatattcaaagtaaactataaataccagtgggaaaactaaaccaaatatagttttgctaagttttaccacatttatcctaaattatgattttataacaagtaggtgcctttaaaacattacatggtcataaaaacacgtaatttgacatattttcagatttgttaatatgaataataacaaagctataccaactaaaatacataaaaagctagttaaagcaaggtattacaagacacagcaatacacttcaattcatctggggaatctagaattaagtgtcgaagaaaatcacttaattaaattttaatttgaaaatactcacttcaggtgtaaacatttccatttataactacattatggtcttaacatgtggcaacataaagacattaaaattactatttcagcaatacagaactatctaccttaaaatatgactctgtgcctaataaaatttcataggtgacacaatgtcttttctcaaagtaaatcatctctcacctctatcttttatttcctagaaatgaggcatgtttctaagccgatatagtaaacacatttttcctttttttattaaaacagctttgttgaaatataatttacatactatagaatgtatctgttttaagttaaaagatttttagtacatttactgagttgtgcagccatctctacaatccaactttagagcatttccatcactgtaagattcctcatgcccattagcagtcactaccagcttccagccccagccccttgcaaacatgaatctactttttgtccctatacatttatcttttctggatgcttcatgtaaatggaattatacagtatggtaaacacacttttaatctagatttttatattcaactaagttcaacatgtatccagaaccaaatgtttaaattgtctttctagaagtttgaaaatatttatcttccttgatacttactactccttctgttttctctctctcatactgaaagagactttcttttaaatgatcacattcattcattagcttcttacttttctcttctagcacgaggtctttctttccactctcaataaagcctctttggatattagttactatctctttatgatcctctttctgatgaacgtcatctagttgctgtacaagccacgcattttcacgttggaggtgacatatcctctcttctacacagttccactttccagtggaattattcactttagcttctgcattttgatacatctctttcatttcctgtgtttgctgctgtgtttggcttaggtcgttttgtacagtttctaaagccaatgacttttttctgagactatctcttgtcttacggaacttatcttttaaggcattgaatttaatttgtgtttcagaaagttgttcagtaagaaactcattctcatcttttactttggaaatagcagaactcatttctacttgtacagaaacatctcgtgttctctctaaagcaagttttaggtttctttctgttttcacactttcactgtgtttgcttatagcagcagccagtctagactgataagattcaatgtcagcttccagtcttttcttgctttctttttccttcaacagttcggcattgagccttgtattctcagccttgagataattaagctcttgttgataccggaatgctgtttctgttatcatttcctcattgagttttatatacttttcaagggcagcatttgtttctttaacaattttaatgtccttaagatatttattttctttttccaagttgtcatttttcattgtacatatttcctgtctgagtatagcaatatctgccttcaaaatgcaattttcatccatcagacctttcatttcttcatgattatgaaaatcctaaataaaacaaaagaaagttttagctagtactcaataaaataacatatcatgattacctctgaagttaaagaataacctgcacatccgtaccactaaaaagtttaccataagtggatatccacctggagaaaaagttgaagcaaaactttgaaccttatagagcataaattccagaaagttcagaaatgtatttagagtcaatgaatttataaaagtaaacacacacacacacacaccagagaatttttaagaatatcagaattggaaaagcctttccctgaattacaacaaactcaaaagcataaattaaagcattaacaaatttgactaaattaagatatatcaaaaaattgcatttacactttgatacctaacccatacaccaccctatagtaagaacttttgttcacacatatttggacagataaaatttcccagagttattacagttctgtttcactgataacattctatttcagtttgactcttttaacacttttatagtcagttataagaattacattcactaaatcataaactagacattatactagtcactcctatatacattcattgatgaactcatctagttaccataattttgaaaaagaaatgttaaaaatataagcaagctacaggattttccccaggacttctgactctacttctagttctccaacagatcacagttacttctgtggtgtaaatacatcaatacgaaagaaaacttttatttcaaaatgccaatagtaaataagataaaatttatagagctcttcttagaatatcatgagattatttgcgattgcaataatttctgcttcctctttataatattaggtgcagtaatcaatatgaaataggggaaagtacaaggaaaaattttacctggaacaaaatttttatcaataggttatcactaagtataaattatggcatattattgttttcaaaagctctttgtaataaaataatatcctatgtggatgccaagatttataataaatattaataattgtacctgtaagtgtcatcattcatttttaaaaatgagataacatttatggttttagacctaaacaatatatattaaatcaagtggatattataagtaacagtgataagataaagtttaaaatatagaatttttaccaaagattgatttacccgatttggagtatttcttgcagtctttgatttcatctctagtgactgaacagttggttcaagttgttttgcttcaacttctttcttatattgtttctctttcctttctaattcttctctattttttttgtacagcatattaacatttgttttttcttcattttcttgttttaaggtgcatctgcagataaagacatttgtcttaaaattcattttgttaaaaaataaggagttcatcctgttatctacctctgcagatgttgtttattatcctaataaaatttctatgttctggattatttttcctttgcagttctcagatatttaatttctcacttcaacatcttcaaatgaatgcatatacttgaaaagtagtaaggaaagaatattctgctaaagtttttgttactagtcactctaatatatattataaaaaaggataccagagataattcagtaaagttacaggttcaaaattacctttttaaatcacacagtcataattactccctaattagaaaagatcatttacaatcaactaaatttttaaagttactatttattgacaagcgtataagttcactagaaataaattttcatctttatgaaatattgcaggtgtttctccaaatgatttacagagtgagatgacaccttcagatgtctctcacacaaactatatctgcagatgactgtcatccaaaactaggctgaaaagtctaacatctgtttccccacactttttatatttctttcttaatactttcaattcaccttcttattacatatattttatatattcattaacctattgttcattatgtgtaatatataattaatgcatgttaattatatattaataagtgtgtgtatgtttacaccagttatgttttcctgtgaaatctagtcccagaagtggagttgttgagttaaagggatgtcaggctatttgaaattttgatacacagcactaagttacccttcagaaataatttactaatttcctataccaacagtgtatgagaatgcctttttcctcacatttgccaacactaataattactttttaaatatcagcatgactttacaaaatatatcttattttatgttaatttgcttttttctgaataccaggcagggctaaatacccctggtaaaaatataaaacttgttaatcataaggaatattagtccaattttcaattagtttatagcacaatgacaattatctcctgtgaaatactgctataggcggccaggcacggtggctcgctcctgtaaacccagcactttgggaggccgaggtgggcagaacacgtgaagtcaggagttcgagacgagcttggctaacatggtgaaatcctatttttactaaaaatacaaaaaattagccgggcatggtggcacatgcctgtaatcccagctactagggagactgagtcagaagaatcgcttgaacccaggaggcagaggctgcagtgagctgagatcacaccattgaactccagcttgggcagcaagagagaaactccatctcaaaaaaacaaaaacaaacaaaaaaaacccaaaaccaaacaaacaaacaaaaaaacactgctataggcttacctatcatgctcttccttcagcttcttgggaaattgctgaggatacgttttcccaatctttctttgttgggttaatctgccagcagcagcagaagatgtactatcacatatattttctgaaagttgtattttttcacttttgtttgtattatttccttctttgacctttaataaaagatgaataataattgttattattttattcaataaaaagaactttttccctgatttttattacttgattcaggttaactatcaccactttaatgataaaagtattttgtgcttactttaattttatcattatacataattattataattataagatactcttattttatcatcgaaatttttgtcaaatctgctcatttctgtttgagggaatagaagaattttccaaaatttcaaaaagggctcttctccattttgtgcttttattcccatccactctttgctatctggtataaatttttatgctatctggctggcagaaacagagaaataaaaagacacaggcataatatatgtcttctgtctttactacctggattttacatgaaatagccagattaagaagatgtgaccttgtaggccttcaggaacagtaaagaagttttcccttttctgtactgagctactcttttccccactgccttttatctctcttttttttttttttgaatcctgtgatatcaaaaaagtaaaggttctctttgaattatgggaaccaacgtttgccacaacaaaagaagcagagtgaaactgctgagtttctagtgcagaattctggaaaatgagatgcttcccagatttcacattcaattaccacaaaagtttataggtggaaaacatatggtacagttacctactttaaccccattatctactgataatgggagtcaaaccaaccaagacatattaaatgtttcatccagagctcttgaggtggcattcactagcatttcatggcaccatataacatgatacaattccatattgctgaattacataaattaccagataaatttatcaaattagatatattaaaagtctaacttgagcaaagcaatttaatgcctcagagggtggaaaaaggcctcatctgcttttactttgaaagaagaaaatctctagatttttgtctatctttagaacacaatgtacagaactcaactttctactaaagagtcaaaggctaaatttttggctaagaaattatgcttcttatatgataaaaatcatacatgccaaaacttaccatactttattaaacaacataacgtaaggtctgattcaacagaaatattgcagagtggtgattttttaaaatatgtgtaagtatatgtttgttttcaaaaatattggaaataaccatgatgggactgtaagttcaaacagtttgagctaagcagataaacttgcatgcatgaaaacacattaaacagactcatttggctgggaatattcgttgcaactctcaaggctagacgtgtttttgtggcttgtctcagtcattgcttccctcccattgtattcccattctatcattaaataaatgtaaattatctctaaatgaatacaagaaaaaagaatctagaatctagagcttgtttctttagcaatttctttatgttgatctggttcagaaggtcacatggtatgtggcttaattagtttcccagctcatacgccacttggaagactgatagtgagacataggttgattaatgaacaaacattatgagaacattctccagaaccattatttagatagcagaactaatctactttgacacataattacacatttagataaccccactgtaactgtacacatgagattttcttgaatagaaaatttgactaaatcaaataattgataaagaggaaaaagaagcagcaagtgaacctctgtctttttgaagttggacttgcttttctccaaagccaggaactcaacttgtaacatgcctacctcattctttttttaattattattatactttaagttctggtacatgtgcacaacatgcaggtttgttacatatctattcatgtgccatgttggtgaccttggaatatcttcccataagtcttctagctatatttttgatgttctctcactatgtggtaaagaataactcacattttataattcaagattcatgcttctgtagttgttagcactgggattgccatatagtggctgctggaataaacgctgtattggttttctgtttttataagtatctgtagcagcagaaatactgtggctttctatctgaatcatatgcttcatttctttggggtgggtaaacaacaaatcaaaaagactttctggatctctagactgaggccaatgcctaatgtccaatttccaattagtggtatctgggtttacattttttgccatttgcatgtcaaactcttaatcatctttcatttcaatcataattactgggttccttaattttttggtttcagtatcattacaaaaattttcatcatctgtgttagaaacaagctatgtgtctggtttgctatcatttttatagtctgatttattttcatttaaatgaagcttagaagatgactggtaactgtatttcagggacctggagtatgaatggaataaaaagacatttgacatgggcttcctctgttcaggcgctgcctggaatgccacagagttagaccctccagatgcatcttcctcctcacaatcagggacctgattcatcagattagagggcactccttttttgttcgtccctctttagagttactatgtaggagctcttcctcagggcaagcagtaattctggagttttcaaaactttcaccaatattcagcttgaacttgtttgtaatgaattttaaagaaagtcgtgaatatacagacagattattccctttatcacaattcttacccagttctggttcttgagacttttttttttttttggcaggtgcaaaatggaaaacaaatttgcttgttttgtttctcagatgccttttctgtcagagtgcatgttttaaaattagctttaatcaagtataaacaaaaatactagaaaataattaaaatttaactgtgaaacttaatctatgtgttgccactcttaaattatgggattgtaactaaaaagtgaaaaataatttgccttggcttaacataggacagaaatatgaactggcaagctgaacgcttagcatttgtttggattaaacttaatgcattatgtgtaaaatctaccagaaatgaattcaaagctgataggtagtattataaaatcttcctctcttacaaagattttacctcagcataccagaaaaagtgagcccctacagtacgtgtatatttctgaagattaactacagactaggcaaacactgaattattaagagccaaactgaacaccaataagaaagggaagcaaaattttaaattctaattcaaataatatactatgatagtgttatgtatctagatggattatctgcttatatccacttctaatatattttaagttccactagtgatagtggatggattttttaaattttagtaacatttactatgtatttatgtcaaaataaagttattgtttgtaccctgacaccaaaggtcccattccacaaggtaggattctcttaataggcaactgggttgacttttatgaccccactcactccctgaacacagacacagaagtcaaatggtgaccacaaaacagaataaatctttaacctcggcactggtgaccagcaatataaaactgcaacatttgaaccattggcaatgatgactcctttaacactagtttaactcagtggccatcattgttaaattgttcacaatttctattccttaataatatgacccaatatttcatgttaccttctgtattatgagtaaggttataacaataaaagagcaagataattctgaaaatgtcttgcctcaattccaagggtaaagacagctatgagttactagagatagtaagaattaccagaataactaatagttactagagatagtaagaatatcttaagtttcataactggttaagatgttttaaaaattaaatataaaattatgatctatcggattctaaaggtatagtctaaaaggtcatgtcatttggactatgctttgttactgaagcaaaaaaacaaaacccaatattaaacaagaaacttgaattttcatatacctgtggttgcttcttttcacttctttcatgcctttcttgctcttcctctgaagccactggtaaggcttgttctgttgacaaattcattggtttagttcaaatgaactaagaacagttagataaagactataatctatataaaaataaatagagaataacatttctttgtattttatattttgagagtttcaatgaagcttaatgtttactgaaatatttagttctttaagaaatacttctaatcatccaaaatttcaacaaaccacttggggagacattagatatcaccaggttcaagccatatgaaatctcagggtcactcacaaattgttccacccaacataaatcaacaaaactgttagaaacaaaacaaaattttgaaatacagtcaaaatatacaatgtaacactttactatacttcataacagtatctttttaacaagacactaattgagttggcagttactaataatttgcaaaattattgttgtttataccttaattagtgtgcaccccattttttacatcgcaaatgttttcccctactattctgaaaaatttattttcatcttttaagactcagaaagtaggctgggcataatagctcacatctgtaatcccagcactttggaaggccaaaatgggggaactgctcaaggccaggagtttaagaccagcctgggaaccatagataaccttgactctacaaaaaattggacaggtatggtgatatgtgcttgtagtcccagctactcaagaagcttaggtgagaagatccctcgagcccaggagtttgaggttgcagtgagtctcgatcacaccattgcactccaccctgggtaatagagtaagaacttgtctccaacaacagaaaaagaaaaaaaaaggctcagaatgctgtgtgaagtcttccttgattctagctgtctttctccacacacacaggtgtctgcttcattggagttccttagtactttgtcaacttttccagcgtcactttaccacctgaactgcacatcatgtctttacatgttgatcccctttgctgttagactgtagaggacaatcttttgaatcatctttgtataaacagtcttaattttgctaaataattacttattgagttcctgctaagtgttaggcactggggtataaggaaggaaaataaaagctgtcagggatggctttcctaaagatcatgcatgagctgagacttagagagtaaggttagccagattaagtgaggcagagggcaggaaagggtgagcacatgccaggcagcaacaagagagggagagaagcctccaagagagtatgtatttctctgcaaaagaggaatggtgagggggccattaccagcagctcagtaattccagagaaaaaggcagatggggaaagggctacagatggagatttgggcagaaatcagtttccttttcttttctttttttgggacaaggtcttactctgtctcccagactggagtgcagtggcatgatcttggctcactgcaacccggcctcccaggttcaagtaattctcctgcctcagcctcccaagtagctgagattacaggcatgtgccattaccacctgctaatttttgtattctattagagatggggtttcaccttgttggccaggctggtcttgaactcctgacctcaaatgatccacctgcctcagcgtcccaaagtgctgggattatagacacgagccaccatgcccaacccagaaatcagtttctgaaatccttatataaaactttaagatgcttggacataggtattcaggagtggttcacagatctatttgcattagagataattaactctaattattgtgaggagcataaaattctgaggcatataaatcaatgaacaaagataaaatataaggcagtgttgcaaagatgatgcaggcctgaggagatgttttcagaaatatttaggacataagtatcagtggccattgtaagcatgaatttttattgaatgaataaatgtatatatctgggtccctggagaaatacactctgctcattactttacaaattttatcaaatgagaagtagaataatatacataaactgtttcagttacttgtatttactttacactttttctgtttcagttttactgtgccaaggaaatgcatttgggttttgtggtggttgttgctgttgctgttgttgttgttgttgttgttgttgttgttgttgagatggagtttcactcttgctgcccaggctgaagtgcagtggtgcaatctcagctcaccgcaactgctgcctcccaggttcaagtgattctcctgcctcagcctcccgagtagctggaattacaggtatgtgccaccatgcccagctaattttgtgtttttagtagagatgtgtttctccatgttggtcaggctggtctcaaactcccaacctcaggttatctgcccgcctcagcctcccaaagtgctgggattacaggcacgagccaccgcgcccagccacatatggggattttgttttaaaagttctgtttcctggatctaccaagctcatgagaaaatagaagcaaacaagtcatttgcataggtaagaaactttggatttatactttgtcatcactactctagaagattatcatcatgttttgtaaaataaaatgttaattctagacataaggggaaagagaaattaaaactataggggtgaaaaaatattgcataatttattactgttgacctgaccatatgactgattaagggcactgaatttaacttgtatgtgaagtagaccccatattagctgcagttaatcaatagaccaggtattctagcagaattaaatttgatgctcctgtgttatctttaaatgatacagctcttctgaaaacccatactcatagtgcatgattatccattaagacaaggtgatggaatgtgtgaatacagctcaggagacaccacaaggcaaatgctcaatggttcccattaatattggggaaatcaacattataatacagaaaaccataggcattatttaatatttggttttggaaggtatttttagtgacactgcatagagttgtacctaataattgcaaaattacagatgtaaaaataaaacaaaggcacattgtgtttgagtaggaaatctgtagacgtctagctggttttctattccaggcccaaaattctaaatataatcatggtacccgcacacaaatttatgttaaataccaacttcaatgaaattactctttctcctcattctctttgttatttatatgttgctttccttaagggaagaatacaaatgccttgctaagaagcattttgtttggttgtaggctgcataaagggagtaaacacaaagtacatttgaccacagaatgactttttaaaagccagaactatggtagcatgaagccaactgaggtaatctagaataaaattttctatgtttgtttcccttctttgctctctttctactctaataactgcgattcacagaggtaatgaagagtataattccctgataaaaacacagctccaagattaatcctttctttaactatgaagttcgtgtgtccaaagtcttgtagttgctgatttttgatcacgaatggtgatacagatatttatcatcaactcacaacttcccaaatctttgaaaagtcttactattgatggttcaactagtagaaacataatctaaaatatctgaaaataaagtttttattagaatgtaaatagtaatacaaattgtaataaggtgtaaaagttctttcttcactgaagcaggaccatgatgtcctctaccccacaaacacactactccctcatggtctaatgtatcttaaaagtcctgtaattgctattaactcagacaagtttacttaacttgttctaagcttctgttatttactacaatttactttatcactcaacaatctctattatatatgttgttttccatgagaaatttttttattaataattaggattcttcagggataagaaaatatttgaataactaagtttgtgcataaacacattaaggtcaaatacccatgacaatattgtgtgtttctctgtactagagacaaaaacttcaaaaaaatttttaatgaatatacattaaaaactgctttcattaaactgagatgatcttccctcaatgcatgaataccttcagaattcacatagaccaaagaattgtataaaatataatagccttaaaaatcttatttgtacctggcacagtggctcctgcctgtaatcccagcatactggcaagctgaggcaggcagatcacctgagatcaggagtttgagagcagcctggccaacatggtgaaaccccatctctactaaaaatagagaatttagcagggtatggtagcacatgcaggtagtatcagctactcgagggcctgaggcaggagaattgcttgaacccgagaggcagaggtggtaatgagtcaagaccgagccactgcactgcagccttggtgacagagcaagactctgtctcaaaaacacaaacaaacaaacaaaacacctaattgttcccacataagtctatattcacacaagatctgaagagtacacaacaccgtgagacaggacagacataaattttaaaagttatattcccagtttctgtaaaaataaaacggttgaatttaagcttttaagacaagtcaaggaaaagagcaaaaaatgcaaaagtgaaacttgaaaggtcattttcccatcaagggctcatgatccactggacattcacaaactatattgttcaaaacattagttctgaattttgatctgagtatccctggagttgcagtttcattcaaagatgtccaagaggtcaaataagacaatatcatttgctattttcagttttcttttctgagaacagcacaacaaacttcttcagagaaatgaattgtcctaacttcataggctaaaggctcatgagtcacagttctaagggcatttataaaatatggtggtgcatgcttgtattctgaacttttcaactttaaactctcatatagtaaatattaatagatacaaactgattaaagaaaagcccacttaatctgacattatttttatttttctttctttcttcatttatcagcaacaggagagtctaactaaatgtggtaaagtggtataagggaatacaatgaaaagtgtaaaatgaattaaaccagagataatcatatcaatgtggatacatctggaaaatataatacaaaatacaccaaagaaagtggcagaaaggtatgtaaagtgtataaccactcacataccattttgggacacaaataaaaaattctgcatattatttctgagcatcacaatatagttaaagatttcaaaagggcattgaaatgaaaaacaaccaacttatgatgtcggtagcctctatgcaatcatgttttaaaaaccttaacaccaaaaagtctcaaaatcaccattttaaaagactgtgtctaccagttataaatgaatcattactttcctcatttttaatagtcaaagatgccacaaacacacacatacacacagctatatatacacctacacacacagtcttgctcattagaacatctgattggcttcagatcatcagtgtaataacactagcagcaagcctctaaagttaaaacagaatctgacatgttaataagtaaagctttcctctaggtaaagttcagaactccaagtagcacttaactcattggaaatatcttagagtctcaaaattcactgctttgaatccctgacaggtataaaaattttatactgaaaacttcatgctattcaaaacattaaaagagaaacatctgagttaaagcttacatttttaaaatcttttttatgcttctaaatttatttttattcaaatatggataccaacaataacatttatgtcaatgccttccattcaattttgaacaaatagaattaggaataagaataatgtgagtacttccaatcattgaatgtacttatttccagtattccattaaatgtacctgctctcaatgtctgtacattctttctttgtactgctcctttcacagcaggatcttctacttcagtgctaggctgaatgggttttaaaagaaaatgattcataaatcatatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtggtactatcgagctgaattctcatgcctggctataaaaataattacttaaggttttgagggttcttcttggcatcttttcattgcctaggacggcaacatgacagaaacataatgaggaaaataggaatataggattcctaaaatgcacagtttacatttcagtagtgagattatgtttcaaatgcctatacctaaaatagaaaagcatggatatcaccgtgaacatgtggactgatgaggagaaaagggaccattaaacagaggagcaaatcaaacctgagggaatcgacgtcaaagctgatggtgaatgtacagagtattttaactcaacacagcagaggcattgctgccagcatgccacaaacaaattccccttgtcttgtcactgaggaaatacacagttgggatgacagttcaggtgaatgtgtgattcacctctcatcaaagaaagtgttctacattgatcagctagtatacacacttatgaaatgacagctaatcaaactactcatttttcccatgatcacatgggctactgcagcacctacatttctcctatcccctcatttggccttgagttagagctccttgatccactcatgcaaggatcacataaaataaaccatgtcgaataagcttccgatatcaaaatatttatcaaaaaagaaaacactgaattaccacagacttgctggatatgaatacatatttatatttcaaaatcagtgcagtatttattgaaaaagagaattttggtattcacagaatgaattttgtaatatcaaaaaaaattagccaaagcatctatatgcaacttaatcacatcttattcactcatgtcagtgaaacttctctctctgaggcctgacagttatcaagtgaaatgagctgctgtggtttaccccaactctagcactccctcctgcctccagtactctccacagcaataacctcttttgtgagactgggcatatgctgaagcaactggaagtgagttgtctcaagtttacttggcttcaactcccaagaccccagcaaatgtctttctttcctccctccgtgtcctttcacaatccctcttcctttgaaaaagtgatttttagaactgtcatcctgatgcttcccttcctaactgctttttatggataattgtgaccacttttttcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcccttgctattcagagctgtgtccaaggaccagcaccaaaaatcacctgagtactcatgagaaatgcagactcccatacctgctgaatcagaatgtgcaccttccagaagctcttcaactcattcatgacaatttgaatgccctgttctacactgatgtgcttccatattggtttcccctaattgcccttttggcctagcctcaatttcttccctattatgtccctcaatttaatactacattataagccataatgtttctaatgaacttttaatcaggcaataacttcttgaattaatttcttctccataaatcacccaacactattcaattatgttaatttggcctatatgatactatcctatgaggttacaacattttctataaaaacaaattatagccatacatggctgaccatctttggtgatgttcatctatggtagataaaacacaggtctgtgtggtgaggtgcctcaatccttaatgcctccccagtagcgaggatgacagcaagagaaggaaaatgttactgtaattctctgacacattttggtactggaagctcactttatcttctttcctgtttctaacaccatgttcttccttcttctacagatcaatttgcctttactatcctctcttacttacctctgcatatgcttttttatttattccatgtacaatccgctctcctcattctttctttctctttattcatttcctcttccctctctcctgacttgcctcaggtcttagagtatcttaaaatggaactcacaattcagctcctttagtggtactcccaatagaatcaactgctgacccttggttagagacacaacttatcaccatttcacttctcctttacttattatacagttaataggacactttctttagctattacactctattagtgctcatattttcaaagaaacattccatcaaatgactttttttgttttgttttttctgagacggagtctcgctctgtcgcccagggtggaatgcagtggtggtatctccgctcactgcaagctccgcctcccgggttcaagccattctcctgcctcagcctcctgagtagctgggactacaggcgcccacaacaccacctggctagttttttgtatttttagtagagatggggtttcaccatgttatccaggatggtctggatctcctgacctcgtgatccgcccgcctcggcctcccaaagtgctgggattacaggcgtgagccaccgcacccggcctccatcaaaagactttttaaataaaatacggttctcaccttctccttgtccattgactattctgtttcctttttcatgcgaagatccaggtaaaggctctgacactttctcggggacacactgctaaggtaatatcaagaattagtttccattttaaaattataatgagttgcatcaagagtttcttatcaatctctttttatgaaactgggtctcactctgtcaacccagggctagaatgcaggggcctgattatggctcactgttgtctcaaactcctgacctcaagcaatcttcccacctcaacttcctgaatagctggaactacaggtgtgtcccttcatgccatgctaatgtttttattgttatctttgcagagacaaggcctcattatactgcccaggctggtctcaaactcctgagctcaagtaaatcttccacttctgccccccaaagtgttgagataagcagtgtgcaccaccacacccagccctaatcaatttctttaaatcaatctcaatgttgcccaggcatggtggctcacacctgtaatctcagccctttgcaaggccaaggtgggtggattgcttgagttcaggagtttgagaccagcctgggcaacataatgagaacacatctctactcaaaaaataccaaaaggagtcaggcatgatggtgtgcgcctgtagtcccagctgcttgggaagctgatgtgggaggatcacttgagcctgagaggtggatactgcagtgagccaagatcatgccactacactgcagcatgggcaacagagcaagaccctgactccccaaaaatttcaatttaaaatatgagaatgaagagagatacaaacaaaaaacaagcctaattggtcaatgaaatatgagcttaagccaagaaagaaaagagacaacatgaagtacaataaagtacatggggaaatagatctataacagagccttttgctctttcatatccctgataatactaattaatatttatgctacaattagttttttgtaagtacttctgtgatatagcttattactataagacattcaattagctaaatatggtcatcgaccactacctgaaagaacattattataacacagagagaaaactagaactttcaatcaactttccacccagaaaaaaattggtcaccagaattctaaagagtaacgtatggcagacacatgaaaaaatgctcatcatcactggccatcagagaaatgcaaatcaaaaccacaatgagataccatctcacaccagttacaatgacgatcattaaaaagtcaggaacccacaggtgctggagaggatgtggagaaataggagtacttttacactgttggtgggactgtaaactagttcatcctttgaggaagacagtatggtgattcctcaaggatctagaactagaaataccatttgacccagccatcccattactgggtatatacccaaaggattataagtcatgctgctataaagacacatgcacacgtatgtttattgcggcactatttacaatagcaaagacttggaaccaacccaaatgtccatcaatgatagactggattaagacaatgtggcacatatacaccatggaatactatgcagccataaaaaaggatgagttcatgtcctttgtagggacatggatgaagctggaaaccatcattctgagcaaactatcgcaaggacaaaaaaccaaacactgcatgttctcactcataggtggaaattgaacaatgagaacacttggacacaggatggggaacatcacacactggggcctgtcgtggggcggacaaggggggagggatagcattaggagatatacctaatgtaaatgatgagttaatgggtgcagcacaccaacatggcacgtgtatacacatgtaacaaacccacacattgtgcacatgtaccctagaacttacagtataagaataataaagagtaatgtatggcttgaaaacgtatatttaatagaacatgagttagagctaataaaaagcttaagaaatgttaatctaaaatctcaatgttaagattccagttgaatgatactagaaaatatattgtaaccctatttgctactgatgacctatttctattttatttcctttttaattatggcataatttctcaacataacatatcaaaacttatacacccttaaatattaaaaaatacaatgtaagcaatattttaaatacaatatttaattattagatacattaggtttattatattacttataacattccattatataaaaattcatttgtctatttattcagattaaacaactattaaggctgaatgtcttatgcctgtaacccagcactttgagaggctgaggcaggcagaacacttgagcccaacagttaaagaccagcctgggcaacaaggcaaaaccctgtctctacaaaactcagctgagcatggtgacacaggtctatggtgacatagctctattgtttaaactacttggatggctgaggtgtgaggatcacctgagcccaggaaatggagattggagtgagccaagatctcaccagtgccctccagcctgggggacagagtgaaaccccatctcaaaaaacaacaactaaaatgcttcttacatggaagactgtattctaggtactccaggatacacacaaatatgtttactgacctccagtagcttacggtatgcaggagcttccaatgattatttaaacaactaaatagaaaaccttctgaaattcaaaatttcagaatatgatatgaggactttgagtggctattttattttttaagatgtagtcttgctctgtcacccaggctggagtgcaatggtgcgatcttggctcactgcaacctccgcctcccgggttcaagcgattctcccaccttggcctcctgagcagctggggttacaggcatgcaccatcacgcctggttaatttttctgcttttgttttgttttgttttgttttggttttggttttttttagagacagggtttcaccacgttggccaggctgatcttgaactcctgacctcaggtgatctaccgacctcggcctccaaaactgctgggattacaggtgagtctccacacctggtgaagtaaatattttaaataaactacaatgacaaaattatgaggataaagtcttaccatccattggtattaagagtctctgcttctagaactggttatttgcagcaaaatacatgttattcaattagatgaagtgccttatataaactcttcatggacaactcataaaccacacaaaaattcctttgcaatacacattttgagaacataaatttaaatttctatatttccacaatttatatttttaaatcagatacgatgttgcccaggctgttctcaaactcctgggttcaagcaatcttcctgcctcaaattcccaagtagcagggactacaggtgtacaccaccacactcagttatttttctacaatttttatttttttttgtctcactacagaaccaataatataagtagaaaaacaatctctcgtaaaaacaatatgataccaaaataataagtttccaagaacaaaagctatatgctatgtgctgaatattcttgccactaaaaatcaccaggaggatcccatgattactgcaaataatttgatccactgaagatttatacaggcataaatattaagaaagtcacactcgtatgatttaaaagtcaaagtattagtatttatccaaataaaccttaagcaaatttcatatttcctctattggagaaagcatttcctaatgtgattttcctgtcactactaattttccagttcattttttttcagctcccaccctgtcacagtacttatcaatctttgttagttaccaaagttaaacacattttttgaatcaactagccatatgtatgtttttctctgaccaactttccattaccaccataaaacaatgataggtaaaccactgctaaatttgaaaagtaaatactatgcaaaagtacattcagagtgagaaaattaattttacaagagaccactttaccttagtagcaacattcaagtctttgtcatccgatgcaggcaatgaatccacacgcagttcatggaaaatgcttgagagcaaaaacacacaacgaaaatgagcaagttgatttctttacaatttttttaactgccagtttatatccagcttccccctcaaaaaaggaaaccataatctagggaaaggtcagcaatctatatattaaatagtgattcttgatataattaaaatatgtcctcttctaaaaatagattttagttacctatttctgcctccacttgtctaaatctataaaatattcaatgaaaactaaccttgagctttataacaaatagtgacagtcaataaattggcagagcctgacaatgatttgccctcacaaattatctgtcctgaagctgaacttaaaattcaattaatggatgacataaattttgttacctaaactggaagaaaactaacaacctaaaacaaggtagaaagatccactgtctcttttccatgatctgtctctggataaaagactaatctgcatcacttcaatatggcagtcttgattcctcagcatggaacccacttaggaaggtcctattgctttcctttgccctaaatcagtacaggaaagcccctacaatatttgaaatgtatgaaagctaaatgtacagaagtcaaataacaaaggtgtatgttcttattgagaatacttttcccagaaagattgaaatattaacaattataaaatcccattattttcaccctataggtcctaccttattcaggtccacataaactagcaagcccttaaaacttttcataggcactcagacacccaaggagagagactgtcagaaaaaaacagagtcctggtaggtgtacctctatttccctaagtactctctaagtatctgtcttcctatgggctcccacttccagattccacttctgcagggctccacagaagtctccaatctttaaatcttcagtctatgaaagcacagattcctgaaaggatggcctcaaatgaccaggactaggagctctctatatccctgctcctgaaaaacaagctaactggagtctccatcacctgcccccagctagacacactaccaactacccaactgaactccatgactgatttgccagccaatcatgcccctgaaccagcccacatggacatgggaaggacatcagtgaatcgggaaaagaggcagaggtgaggagacacctgtactgggccacagatctatgtagttcagcaatctccagccccttagtactccaggggctctaagccacccctttctaagtcaggatggaagtagatgacaccacatttctatctgctgcagacgctcctcccagtgtctcaaaatgttttagcatctttcagtaaaaatcttcaagtttgtcagtccttgatttaaaaaaaagcagcaaactttttagagctcccttgaaccttctattttaatgtgccttcgtagataattcccaacatcttgtgtccttcatttttataatttatctttatcaaacttgtcataaaccccaatattttgatctcttatagaagagtctgtactcctatccaatccagtgttgtttatcttcaaacttggacttcccctgctcattccattcttatctacttccattgggttccccagctaattccattctcattctacccacagactcactcccgtttgtattattaaaacacacgccaataggatataaaaagaagcaagagtactgggctttaacatgagttcaaatctcatttctgccaattcctatgtctaaaaaaaagcatcctaaactctttgagcctcacattctctatctagagaatcatttgaccagaatgttcaacacaggtaaaaatactagaaggtattttaattcattccaagattccttaaaattctgtaattctatgtcctcttgattctgtctatagaaaaacttagaatacatagccagcagagtttgaaaaaataatagaacaaaagaaataccaagaaaagcagagaagaaagttttaaaaaatgaaggcaagattatagaaaagtcacggaaaaagcaacaagactaaaaaatgtattatggaagtaagcagaaatacttgcctaaatggaaaaccaaactgggaagtcaaataatttgtctctaagacttgcctaaacttgcttttgtaaaacttacacccctatggcaaagctaagtaagatctgccctagagcctttgatggtaaaaataagatactggttaccactgaaattgtcaaatttattaggacaaactcttggactaaccacattctaatgataaacttaaatgagagttcaaggtatttaaactctcattaatttagacattaatcaaattaatcaatctgactaatctgattcagacctataccttgatccaagggctgcacagatatctgtcaatctatgctgaggagcaagagacaggatttggaaggcaggcaggctgatggtcaaactgtaggccagctactttgttaactatgggatcatgaggcaattaatcagctctaatccatagttgtttatttaataaacagtaggttataggaacacagatgttgtgatggctttatgagatgataaacgcatagaacatattaggatgtctagcccagaatacaacactcaacagatattcgtttcttccatctatattttcttagttaacataattttttaaatctataaaatcctacctgactgcagattcatcagaacttccaacatctattaaagaaaaaggtaaaatgcattttaaatcaataacaaatgtacagaatattaaaagcataagaatgcacagtgatgcatccctctaatccaaactacttgggaggctgaggcaggaggatcacttgaggagcccagaagtttgagaccagcttgggaaacatagtaagactctaccttcataaaaaaattgtgcacacttgtatgtatgctttagatcctgttttttgttgttgttgtttttgttttgttttggtttggttttttaaagcataagactgatgctttgttacaaagcattcctttgagagcatgcctgggaccttattagaattaacattcgttatacatattggtaggtaattaatgcagtaagaactcttccctttgtatttattagatgcaaagaagaataaatttattaaaatttggtatctacaagtgaactgcagtatgcaagtcatcttagccaaaccctatgaggttgagtaaaaatggtattgttagcagaacaggtgtgatgagtcaccagtgtcaaagagcatgatttctggaccaaaatatgaggcgccattaaaacagagtacacagtagtaccccttatccactatacgtgcagaaagacatacttgacacatttttctctactgtcacaccacagcaacaatcatcaacaaagaaggcttctgtgaccaaatgtgtggagggtttttccccaccaacaagcaagcaatcattcctgctgatgacacaattcaattctcacaccttatctgctggtaacatcagattcaatttaatttataaattaaactttagcatagatatgtatgtatagggaaaaacagtttgtgattcagtactattcatggtttcatgcatccacttgggggtcttggaatgtatctcccacagttaagggggagctactgcacttattttgttataacacaacacagcctctctagctcttcagttcaaactgctcagtttagaataaaacaccctaacaccagatgtcagcaaaacataggaatccgaccagaaacaggaatccttgcaaagactttccagccgctagtggaaaagagctcaaaagagatcaatgtattactctggctactactctttggggaaggtgctgggtggtttacttagttgtagctatttgctctgccctacatatagcaaggcccaaattcacctgccattttacctcccacagaaaaaccactggaaagatcactcctttaagagcttatacgctaggaaccacacctcacattcagagagaagctgaagaaacaccagggaggtgtggcaggctgctggacagtactatatgatgtgaaaaatatatagaaagaaaaccatcaatgcccttttactaccagaatgttccagtgcttgcccttctccctagtaggggaaaaaaattctttttcacctcacagaaagcaaaactctcttgctatccctcatgacagaatctagttgtaggtgagtcacatcatcataatacaggctgttgtcaacctcatccctcaaaggaagaggatcagtgaggaacctatgtacttacctatagcattcactgtctggtcttatttccaaccgaaggtaagtatgaaagactttgtgattccagttttataaagtacaaccccttgcacttgtccccttccattgctagagaatctatctggacccacctcacagagcaagatgctccagtttgtgctgtgtggtacagcatggtgtccttttcctcaaccctttctattatgtgcacatatctatacaaatcatgttttctaagtatgtaaagcatatgtcatcagaatatatcattctttacaatgataaagaagcaaaagaaaaacaaaaggacaaagaacatcttaaatgactacattcaactgccatggagctttaattttttaactattcaaaaagatatccactgtattattccaactatgtgactcttctgaaaaaagtaaaactatgaagacagagtaaacatcaatggttgccacgagttactagggagaaagggaaagatgaacaggcatagcacagagaatttttagggctgtgaaactgttctgtcgataatattacagtaatagatacatgtcatgtcattatacacttgtccaaattcacagaacgtacagcatcaagagtgaagcctgatgtaaactatgaactttgaatgattataatgtgtcaatgtaagttcatcagttgtaacaaatgtaccactctctggtggaaaatagtaataatgggggaggctatgcatgtgtgggaggcatgggatatatgagaaatctctgtaccttcctctcaattttgctgtgaacctaaaactgctctaagaaataaggttattgatttaaaaaaagatattcagctgggctcagtggctcatgcctgtcatctcagcactttgggaggcaaagatgggtggatcacctgaggtcaggagttcaagaccggcctggccaacatggcaaaacctcgtctctaataaaaatacaaaaattagctgggcatggtggctggcacctgtaatttcagctactcaggaggctgaggcaggagaatcgcttgagcctagaaggtggaggttgcagttaactgagatcgcaccactgcactgcagcctgggagacagagtgagactccatctcaaaaaacaaaaagatattcactgtctatgcatcccaggatctccagaacaattacaataaataaataaataaataaataaataaataaatggctgggggcagtggctcatgcctgtaatcccagcactttgagaggccgaggtaggtggatcacctgaggtcaggagttcgagaccagcctgactaacatggtgaaaccccatctctactaaatacaaaaaattagccaggcatgattgtgcatgcctgtagttccaggtacctaggaggctgaggcaggagaatcatttgaaactgggaggtggaggttgcaatgagccaagattatgtcattgtactgcagcctgggcaacaagagcaaaactccgtctcaaaaaaataagtaaataaaataaaaaataaagatattcactgaacctgttactatgatatatttaagcaagacacggtgaccctaaaaattagagatcattgaagaccaaagtaacaacatgtggtcattacttctcaaattgaactatataaaatatataaaataaataaatttaattgcatgcttaggtaagaaaatattgataaaaataattgaatattttatcttatttcataattctaaacagggatttagcacaatatgaaaactagactattcatgtaatcaaaataaaagacaatttttattctaatgttaactcagaaattattttgcttatttaatttaacaattttactgaaaggttaatgagataaataggacagattataattacctaacattgctatggtaacttatatacaaatagctgttcatcaccaaaagtcaaaaaagtaacaagcactgcaacttaagatggattatacaacagaaattagtaccaagttaccttatcttataatattatgttattaaaatgaaattttaaaacaacaccaaaaattaagttggggttacaagtgttgtgcagaaaagatttcatatagcaggcaagaggctgccatccttagaaaggcctgcatgcaaggctggcccttggctggtgtttaggaaattggaaatgggagggtttccaccattccctgagaagagtggctcactgtgtctaaagtgcttatagaaacagtgtatttactctaaacagctgctttccttgtaagagtctggaatttgggtacatgtgagggagagtaacctccatagaaaaacttgggcacttagtctctaatgaaactctggtactggtagacatcactgcacatatgttgtcaaaatgtgagcctgggagaattaagcagatcccgggaactccacaggacagaactcctggaggcttgtgccttgtttcctccagaattgaccacatgcacctttttcctctactaattttgcttgtccccttccttgttatcaattaaagatctgagtatgactatttgttgagtcctgtgagtccttctaatgaaccaccaaacctggggtggtcttgggaaaccttgacacaaattcattgtgtaagatttgtattaagttgatatgatacgtgtaactgtaatcagatggttatttcacagaataactttacctaatctgtttttcttttctttttttgccttgatatttgacttggagattctcgtatttctatatctatccaattgaataaagccatagaaggaataaatgaaaaaataatgtcagaaaataatgtgaaatgagcagcaatcctcttttatctgaataaaaaatagagaatctgggtgattgacaatatgttctacaatatgaatgtttctagaaaaaaaatgaaaaagtggtcaattttctgcaactcaactgggcttcattcctttttataataattttgaaggccaggtgcagtggctcacacttgtaaatccgagcattttgggaggttgaggcaggaggatcacttgagcccggaagttccagaccggcctcggcaatatagtgagacctcatctattaaacaaacaaacaaacaaaaatcccttaaaaagaaaattagccaagtgtggtagtgcatgcctgtagtccaagctacttgggaggctaaggtgaaaggatcatttaaggccagcaagcagaagttgcagtgagccaagatgacaccactgcacaccagtactgacaacagagggagaccctgtattaaaaataaataaacaaataaataattgtgtatcaggccagatgtaaccacacaaaactgtagtcccagctactcaggaggatgaagtaggaggactgcttgagcccaggagttcaaggctacagtgagctatgattgcaccaatgaatagacactgtattctagcctaggcaacatagagagaccccatctcctatgataataataattgattaattgtgcatcattcaagtaaattgtgtaactggagaaaaacatatgactattgaatatactattatagtctactactgaccatagagttcctgtttacttgcttctaatctttttcttcatttctcataaaactgaaaacatgatttaaacccattaaaggcagttcatcacaaaacaagtcaaaaagtcaaaagaattgcatccaaacagtaggatgcgttatccaccgctctctgtgaacagttggatttggtcattaagaatcagcaggacttttaactttgtgtctgtgtgcacaggtgtgtgcacatgtgcacgtgtgtatgtgtatgtatgtaaactatgacagataaaatcattttgcttgtgtacgaatatgtaatataacttgtgcttctcacaaaggaattgcttttccgtctcctgtgctcagtagctgtcttcaaaaaataatctcctatttgtatgggtgcacactggttcagttctacagttcttattgccatttatttatggtaccagaaagggattgctgagttcctggttctaaagatagttactttcttagtgacacaaatcaatatgtaatacagttcacccttgaacagcaagggtttcaactgcagggattcacttatatgcagattttcttctgcctctgcaacagagagacagcaagatccacctctcctcttcctcctcagcctaatcaacctgaagatcatgaagacctttgtcaggactacttatgctttatgaaaagtcaatatgtttctcctgatgatttcctttctaacagcttcatttctctagcttattttattgtgcgaacacagtatataataatgcagcaaaaacaaaataggtgttcatcaactgtttatgttatcaggaaggcttccagtcaattgtgggctattagtagctaaggtgaaggaatcaaaagttatactcagattttcaactgcacagggatcagagtccctcacccccacattattcatgggtcaactgtagttatttgtttactaaatataaacaatttattataaaaatgaaatcgaagatccatttgtataacaagtccaatttgttataatgtgactatagaggaaacatacaacatactaacttaaaaatcttttttcttatttatgcaaaaatattatataggattttagggatcataattaaataaatgaatgttttcagacaataatgtttgagattgtaaattagctacaactaccttcttaaataaatctgaatttcaaactaaagaagttaaattttaaaaattaatttacatatgtatatacatatatacacattcaatttacacatatttttaaactggtcttttttgactgaaactaccttaatcttacatcttactttgtattttcttatcaagagtaggaccaccaagacaagtaagaaattcacaatcagaagtcttacctgatttctcctttttaagtatcttctttttatgttccaaaatttgttgttgaattctatgtatacaaaagtaataaataaaattgccatttttataatgaaataaaaaatattcaccaaacatattaaattccaaaacactttcaagcaatatcagacctaatatcagaattttaatgtcccatacacttcaaatttgtaaaccttacaagcttattaagcttataattaaagaagaaaagaaagtgaagtactcataaatggaggaagcacagctcagtaaatgaactctagttagctggatatcatgcaaagtgtcctgcactcagagtaagtccttgctctgtaaccaaaatacctcgctctgtaggtattttgtcttcagacaagttgcttctcttaggctccatggtttcttctaaaaaacaaggattctgctaccttacttcactaggttgtttggaagatgtaatgagattacatgtttatatgttcagagaaatagtaaagcaatggaataatttattcttgaactttattgctgaaaccattttggaatcccaaataatgctcggtgtgtgtttttctgtaagttctaatactcaaatgttgcagttttcagaaaatgttattaagtgctaattttggttattacttgtattcattgtggcttgtaattcagggcattttacctaattcataacttattactaaatttctatatatataaatttagtgagctcatcactgagctcatcaatcacaccaagggcagaaaactaataggtgtcaaaacctggcttggacaactaccactccttctctacctcctcaaactctgagccagcagatctgtgcttggctgctggatctccatggtcctctccaactaacagacaagacaaaaccctgctttgattgtttttcagttccatgaaggaaatacaagttgacattttctcatttccaagacatgtactaacaacatgtaacatccccttattactcagctctgttcccatttcagagatcaccatacatcaatagtttcatagcgataatcacaatttcaatattgcgtgtcacctgttttggttttgctcacactgcttccttggagctactcaacaaatagtcaaatggcctacctgggactaggcaaaatatggaatgttttctgaatttgtgtgccatccctaggcagtagccatgcttatctgctctgtattgatccaattttaaaatatgtgctgttgaaataagtacaaagccctgtttgatacatggatattcatgagtcatggatgaggcttagctctattaaatccaactcacttacttcagattcagagaattttattgaatggcttcctgtgaggtagaattttaaaatatattgaaaacttgaggaagagctgcaagtagcccaggagattttcatgattatagagacacattacttgaggggccaactgcaagctggttcccactactcagtggaaagataacatggaacattccgctatctaaccaaagctgctgcacaggatataaaaaagcctcaaggtacagatctgatagcaaaagagacagggaactctgatctcttcctgcaacattatttgaacatccctgactattgagaacaatcccaactaatattggttaaaggaaagacaaacatggctctcaaaggataacataccacgaaggcctaggcaaagtctagctaagacgtgggctccaaataaggtttttagtgtagggtgagcatcaacttgctcaatatttgtgtggataaagctaggaggcctagctgccagagcagggtgctgggaacaatgactgagcacaagtacataaactaataaacaccgtagctttgacctctatatatgaatcaccatgaaaactgaggggtctgaatcagtgaaggcatcctggtggcaaaggtcaatcattatcagattgcaggaccagttataatggcaataatacagcaagtgagtccatggaaacaacagaatgattagaatggccttttttccccttcttctgacttgtaaagaaagattgccttccttggacttaggaaaccccttagcttcttggaaaattcaaagaaggaagacacaggagagagccccaggggacaatacatgattttctgttaaactggacattacaagactcaataactaattagaaaagtcaggccaggcatggtggctagcactttcagaggccgaggcagggggattacttgacctcaaaagttcaagaccagccagggcaacagagtgagaccttgtctctacaaaaaaaaaaaaaaaaaaaaaaaaggaaaggaaaggaaaagaaatcaaagacatggctctttttatcccatgcatggggattatacttagaataaaatgaataacattgagatccctagggataaatgtctcaaaaatccagaaaaaatctcgcactctacttctaactaatctagacttctgcttgatttctggctaaaaggtagactaactcttcgctatttcaaactatctgaaccaaactatgaactctcacctaatgcataagatggagtagttgcaattattttaaacttcaatttagcattaactggccttttaacataaacacttactttgtcaaatgatgagaaatagcataatcttctgcatctcgtccacacatgtcttgagcgaagacatcaatattttgcttaagaaggatattgacaatacctggtgagtcatagtatacagcaagcatgagagctgacctaaaacaacaaagaaataactccactcaagaactttaataaagacttttttaaaaagctagtttgatacactttaccagtttaatatccgcctgtcagtatagatgtaataactatttgcatgtactagcttgggtctataagcatctagggtgctcaagtgttcatctttgtaaattgtcaccaaggctaaaagaaagggacaacagggaagcctcttgtcccactggggtaagacataatacaagttgctaacttatagtcctttgatggccaagaaactgtgctgaggtcacttatctaaagtaggcaaagatttagatgaagatttccccattgctttcctagtcaaatcagctaggggtcagataagagttatctgcaggctgaaaacaacaacaacaacaataataataatgacaatgctagtagtcataaactaaaagtccacactttgaaaatgaataaaacttgtcaggtgcagtgtctcatgcctgtaatcccagcactttgggaagccaaggagagcagatcacgaggtcaagagatcaagaccatcctggccaacatggtgaaatcccatctctactaaaaatacaaaaattagctgggcatggtggcgtgcacctgtagtcccagctacttgggaggtcgaggcaggagaatcgcttgaacctgggaggtggagaatgcagtgagctgagatcacaccactgcactccagcctggcaacagagcaagactccatctcaaaaaaaaaaaaaattaataaaactaatacaaaaccctttagctaataaaagattacagtacgaaaaacatctgattataaataccaaactctgtatattataagagaagatgaatcctactatatactattctttatgttactcagtccaaatatttgcttgtctacctgattattcatggtgatatttttcattatatgccaataattatgttaatcttcttattaatatttctgacttgagtgaccactctagaatactcaggttttatttttaaaaaaagaactactgtaccgtctcagcctatcaacggcatgtgaacttgctttccttttcaataaaaattccaccattttctctttcttgcaaattatagcaaataaaagtggggtattattgtcctataaaacagcagaaaaaattaataattcacaaaattacatatttctcaactgaactgaaaatcttctccaggatgctttgaacttcaacatacaatatagaaaggaagtaaatgaaaagcagtcccttcattctcactcctctgtgctttctgatgtgctgtgctttgccttgcaaacaaccctcctctgtctccctggattaactgtggtcattgccaaaactcactttaaacatttactagtcccaagaatccttgctttgatcacagcacttatcatggtacattgtagtcatttcattgtttcccactgaaaccaagagcttcttgaggcaagggcctaaaaccctaagacacagtagcaaatattttaagttttttacattaattaatgatctaaattactatctctaaagcagtgtctcttaaactatattccaaagaatatttgctttatcagaagtattataccgcaagagaaagactccatgaccatctgtatttgagaagtattacaaaactgtattttatgtccaataatcaagaaatctctttaatttcacctaatcccctttcacaatactatttgtggcaaacattaacatttgaggaattaagagtttcagagatacagttgccagagcttcccaatacaggtggcagttccctctgggtggtacaaacttgcttgattcacttttatcaatggtgtcaggatcccagatgccaatgtcaggcactcctgctccaaatgggtcaccatggaaatgagctttgaattaagagagattggcttcaaatgcatttattttccttattattaaatagtccatgggtttttcccctaatacaagagaagagatttttatctttactgttagaaagctcagtatattctgtgtaagagagataggtttaaaaaacttaagaacaaatattttaaaaaccaaaactcagtaagaaatactattctcaattataatggtaatcccgggaccctagtgcagctctactttttaaatccatttttactggcttccacttaaatggctacttaaaattattttttattttagacaaaatataaatcagaaataaaaacataatggcttatcaatagaagttctcatactgatccacatggattatttctggcataatacaagccaataagtcacttgcatccttaaggaagagcactgaggagaaggatgtactgtctgcaatattcataaattatccaactataaccaggaataacctaaaaaggcttctaggcattcttatgggcagagaattatttgtggtatatataaagaaaagagttaaaaacttctaaactctaaaattcaactccataactgagggatttatatactctatagactatatattataaacaaatacatgctgacttaaaaaccttgaaatttttatcaaaatatactataacataggagttgtaaactcagatacttacaaggacaaaggaaggttgcctgagtaagggaagtactaaggtgggcacagtagcaaactggagaatacctgccttctataaaggggcaacttctgcacagcagaccaaagaatgatagaaactcaggggacaccagatttgattttttaggatatgcctgaagtccacatttcttcacgagtcttctaaattttacatgttgattcaacttatagaggcaaacaaacaaatctgtgtaccacattagaatacagcccttgttttttttatattcgctattaatgtgttactaaatggttgtgtataatccaagtattttcatgtaaaatattttctttctctggtatcatatgttctaccaaaaaatcaggctctcatatataataaaaattgctaaaaagactcacaatacctgcttcaagaatttttccaacatgtattcatttaaaatatgtttgtatataattttcccagattgttaaccaaatagataattggttcacaagactgctaaaactaaattattaaaagaattcctatctatattcttattaacttcatggatttcagtgtttaaaactgacattttgggtatgctaaagttctataaacttaacaaacatactgagatagttcataacaaaacttcaactaaaaaaaatagtttaggatttgctactattctaattgagaaagccaaacttgtaatgaacatttgttgacacataatcacctgcgtggtgacaaagggacatgaaatcatgaaagggtcagcctctacctattgaaagattactcataagcaaatttctgaagactctctgaatggtagtgaatgattcatggtgggaagcaaaacatgttattctgtaagctgagagatattgccaatgatattacctttcacttcccagtcacagatgtagagaaagacagataagtcaggctaatataattgaaaaggagaactttgaaggaagtggcaactatcaaatgccaactcttctagagatttcttacatttttgagatacagaaatttatatattgcacttatctattctggggtttttaatcaagagtgtatcccaaccttgaaggttttttgtttttttgtggggtttttttttggctattattgttgttagagacaagagtctcactatgttgctcaagctggattcaaactcttaggctcaagctgggactacaggaatacaccactgtgcccagcttcaagaaaacatttttaaacacgttcaggccttaataggtctattacatcaaaatcttcaggggaaagcctacaattgtagatttttaacaaaatgtcctcaggtcactgtaatgcacaattctgagaatcagtgcagcagacaatcacttcagtctcacctctcacccacatggctaattcctttatcagttggagatgtggccaaaaagagaaaagagtaagagatagtgtcatttattaaaactccagttaagtttcctggctacgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaacttaaaaacaaaaaaaaacctcttcctggcattttccctcattatctaatatccaagtgacctgcatatttctgattgctctctttctcccctcccatttttccctcttaagccttgccactgaaagatgatacatcagtttttcagaaaattagcagcaacagcaacatgtccctttattgtaagttgctttagttttgtttgagttttaagataaagcctaattccggggaatattttctttcctgtgttgttttacactaattaagaaaaaaaaaaaaaaaagaataagcctgtgtagaaaaaaagttgaaaaggttttacctttaacaaattcacaaatattttccaaagtgcattttataaagctgtgccctttaatgcttctttaaaaatatcaatatttaaaataaaatcttagacaattaagttatttcaaaataacttaatttgtatttgcattcagggaatggttgagcttccaaatataaaaaattgacccttacctatgtcaatgttaaaacaaatattttggaaagaaagttgattgacctataccttgtccagtgcttcaatatgtgcaccatgggaaagcagtttttctgccagtgaggtgctctcactatacacggcataatggagagcagtgttgccgtagatatccttaaggtttggattggcgccatgttccagcagaataacggcacaagcctcttcctggcaatggacagcctgtccgtgttagaccaagaaacagattgtaaattccaagaattcaaaatacacattccacaggtttcaccaactagttatatgtaaatgagatcaatttattttaattctatatatgtaaatcaaatccatgtcatgctaaaagagttggctctaatatacctgtatcaaaggcgttctgttttctttgtcacagacatcaatctggcattttctgttaaccaggagagtgaccacttgcacatggccactggcacaggccaagtgtagagcagttctatgagagtaagaggattttttaagaaactgtagtacaatatctcaaaacatacaatcattcatgtaatgtaaaaactgaatagcatgtttttcctctgccttcaaaacaaataaattttttgaagaaagtacaatacttactagctcttattgctcactgccttaatgaaaacagcagcctatttgagtagaaagagctcagtctttggattcggttcaactagggcttgagtcctactttaagccttgacacttaccaactattgcttagcctttctgtacctcaacttcctcattaataaagatgacaatagtagctatctcataggacaccatcgtgatgcttaaatgagaagctatgtaaagtatgtagaacagttcctacgacaactcaataattgtaagatttttgttttttgagacaaagtctcactcttttgcccaggctggagtgcaatggtgtaactatacctggaactcctgggtcaaatgatcctccatccccagcctcctgagtagctgggactacagatgagcaccagcatgcccagctatttatttaaaaatttttgtagagtaagaatctcactttgttgcccaggctggtctcaaactcctggcatcaagcaatcctctcaccccagcctcccaaagttctgggattacaggtgtgagccactgcacccagccagatattataattattactattactactacttaacaaaaccattttaattaggtagaatgatacaattatacctactttgcaagatgacttaacgagtaggtcacattttaacacctctgacattggaatgccacttataattcatgatttgttataactataattggtagcattttaaaaattatcttattgatatataaaatatcggggcatcacgcaatccatgagaccttacattaagtagaatatggtatactcagcaggtctagggcagttctaggcatgtaactgaaacttaaatacattttagttcttaaaggtactatggggaaagagcactgaaataacaataatgcattttttaaacaaattaattctttgattttcaaacaacttgaaaccaaaggaaactcatgattcaaatgaatacatatggctcattgtattcaatatttatacttagaaaatatatgcaaatacgactttccaatgattaatattagtatttaagactgataaactttcgaaagagcagttaaaggttatcttctactattttctaacttcagaaatgcttttgtttgaaaggtgggagataaagtttcaaggagattaagtcccaatattcctattttaaatctctcagcttgtgcaggcggggcaggtaaacatgaagtgtttaaggatggacgggtcctgagagatgatagaatatgtctgctacatagcaggtactcaggttatgcttgatccataaatggaatgaaagaatggataaatacagttggggagttcattatttttaaataaactcctataaagcaatatttttgcaatagtaattatttatatgtgttgttttatttttaaagaacacaattaaaatgaaatgattatgtttgcataaatggaatgagtatataagcaaaacatatgtacataataaaatatatagataataaaatctggaaacagataaaaacattccttttttacttctgaagaggctaaaagctcaaagaagataacaacacacacaataatgataaaaaatagaaagtgagaaattattttcatcagcgcaagattcatattcctctcttcccaaggattagtccattaataataaacttttactagaagttttgtactcactgcagcaatcacagataagaaaaaggaaaaaaactttacttaaaatacaaatgctcagaaattacaaattttatattttgtacatatttttgctaaaacaagaccatagtatgtttgtgtatgtataatttaactaattttttctccttgctagctataacaaaatacatctttgcacatcaacgtacttctgtatctactgccaccttcagtggtcacatattattccatcctatggatgcaactgaaatttatttataggatccattctatgggttctctttaaagtaagtactgtgaaaaataaagtgcatgtatctttatttcctaagggtattttagtataatggaattggtgggtaaagggcatacacattttttaaatgtagtacttaccattttcaaatgagtactttgaaaagtaatcagcaacttcaagcagcagtataaaacatcctcacaaatattgtggatagaaaactgtttcattcctcttttagtttaaattcttataccagaaatgcgaaggattttttcctatgtatataagtaacttgtagatctggaaaaaggtactttgcccacttttagagtgtttgatgatttgatttgaaagaatttcctgtaaaatgaagaggtacttttcatctaatgtgtatatataactgatatatataacatattatatgtgttatatatgtatacatatcagtaatatatatatatcttatgatatataataaacaacataggccaggcgcggtggctcacacctgtaatcctagcgctttgggaggcggaggcgggcagatgacttgaggtcaggagttcgagaccagcctggccaacgtggtgaaactaaatatacaaaaattagccaggcatgctggcacctgcctgcaatcccagctacttgggaggctgaggtaggaaaattgcttgaacccggcaggcagaggttgcagtgagccaagattgtgccattggacaccagcctgggcaaagaagcgagactccgactcaaaaaaaaaaaaaaagaatataatgaattccctataaaatgaaaacatacttttcatctgaaaaaatatatatatataatatagtaaatatttttcaagtaagctctcttatctgagaacttttcgcccactgaaacaactcacggttatttttgataggggaacaagtactctcattaggcacctcctataatgtatataaaccatgttttaaacgtgtacgttaaaaataacaacgctgtatatgcttaactttgtgagttaaatcactcaaattctccaactgctccagccagggaattatgagggatggaaaacagatgagagtccgtttggctccgccgctccgagggtgcccggcgccctgcacggccccgtcccagggtctgcggggaagccgggcctgggggccccctcccacccccggctgagcccccgctacctgtgctgcttgtccagggcgtccaggtctccgctcctgcgcgccaggcagcgctccacctccgcggcgtcgcctttgacagctgccctgtggatcttctgcagttcggagtcccggattcggtatccggaacccgtgtagacgtggtctatggagccctgggccgtctggcccctgcggctcccgaagccgaataacttcatattggtgacttcttctcagacccccaaccaccggctcttgagcgagggcagctccctgtcaccttttcaccacccccctccccgaccccggccgacccagccccaaatcccctatccaaccccaaagccccgatccaaccccaactccgctatttcaaatctataatctactccacaatccgcgatccagcccggtccaccacagccttcagcagcgacactcgcagcctccgacctctcagaccgagtgagcctcgcaaagccgttgggcgcgcgcctgcacggcagttgctgccgggctcccagaagacgctccctggcggcgcgcgcctgcaccgcggttgctgccgggctcccggaagacgctccctagaggcgcgcgccagcaggtggggctgcagctccgggcgtgcgccgatgggctcgccggttctcctgggatcgcccgggcggccccaggatcgcaggcgcgcagccagcccggcctgagaaggagggcctgtctggccttgcagcccgccccgctcctcctcggaagggagatacggtgctggcaagggcactccgcggccacctgagtggcttcgcggattggctgaacgctgaggctctggccctgaaatctgtgtggctagtgtcaggtagctggagagggatggaggcagagtcaggggctgctccttcccccacccgccctcactgctgccagtgccacacgcgcggtttgcagctgcagatctggcactggcgcaggttggcggagcttcctttggatggcctcagggccgcagagcgcacagcccacctggcctcaaggtccgctcctcttggacatctttctggatcctgggccctggcgctgggcactctgtgtccacacggatgaaacagcggctgctggcggggccggttgcctgattttgccgcctgggggtctggcctcaggatccacgctactgcggggcgggcctggtctggagtgtccagtcacttgctgccggtgcaccacgtctagactgcagctgcggctccgatgccggcgtgagctggcgggcctggtacctgatgtcctcagggtcaagtgcatcgccctcccacttgagaggttgctctgacttggcctcctccaagaacgcaggggccgccgggactggctcttcgtggtaaccgggatggtaccgagcagcaggttttcaccctggtgccactgctgtgcggactgcctgacttgggcgcccaggcacccgccccagggtccgcgcggcaggtgtgcaggtagggtgagtggcgcggagggttgggggttgctccgtcatctctgcccgtgtgcaacttgcagttttgcagttttctgcagcagctgaggcgctggcgcgggaaggcggagctcccctggatggcgtcaggtttgcgggcacagagcacagcccaccaggcctgaaggtccgctcaggggccatagtggttgagttctctgtggaactgggatggggtgaacagccagttcccgtcctttggccgcctggccaactgccagacttaaccgctgccgcccaggcatctgtctctagcgttgccactacttgggtagaagtgggggtcggggtggggcgtggagcgtcaccggttgccaagccagcactgtctttgcaacatattcagatggcggcgggcagctcgggcgccagcatgggctggcggggctcccctggacggccctcaggtcgctcacagcattgtcccaggacttcctcggcctgtgccaggtgggcaaggtacaggggtagcttccaaggcttctatcccaactctacctatttctacctattttctcttgagttattttgcctttatctcagttttatttgcaaaaatagtatacgcaaaatacatcgagtgaatgcacatcaggcatatagaagatctggcagaaacatgttttctcctgctcatttccagtcagtatttgaacacagaggcttccacggttttgattctttccacaaaaggttagttttgtctgttttcaccatttatgtaagtgaaactataaattatataatttttatgttcactcactaaacatgcttgtgacacatcattttgctcctattgattattcattattttgtaatattcaattttatgactataccacaggtttgaggcctttgcttgttttgtttttaatccattccactattgatagacacaaaagcagtttctgatttgaggctatcatgaataaacctgctacgaacaaatcagatatacatatttttttctgtaataatattttcacttttcttgagtttaagtacataagagtggattttctgggttataaaataagtatatatttggcattgtatgaaatggggagacattttcctaagtggttatgccatcttaaactacaatgaaaatgagagaatcagttccactttccaaccaatacttgatgctgtcagttgttttagtattatccattcttatgggatataactgctgagtagctgtctgccttctcccataacacagaaaattgagggcccagaggacagttttattttcatatttgacatcttctattattttttatagaaggatgatttcagtagtaaaattttctttcaattttctaggttgtctctgaatcttactggggttccttgtcctaaaccacattcagaaattttcacgaccgacttcttatctttgtcataccaggccaatgagggacagcattcctgagactttttaagtactttgtgtgtgtgtgatggtctaataatcatagccttaaaactttctggctgggcatggtggctcacacctgtaatcccagcacttcaagaggccgaagcgggtggatcacctgaggtcgggagttcgagaccagcctgaccaacgtggagaaaccccaactctactaaaaataaaaaattagctgagcatggtggcacatgcctgtaatcccagctacttgggaggcaggagctacttgggctgatgcaggagaattgcttgaacccatgaagtggaggttgcagttagccaagatcacaccattgcactccagcctgggcaacaagagtgaaattctgtctcaaaaaaaaaaaaaaaaaaaaaaaagaatctcacacttctgggagacactgaatttgtgaatgtgtacagcatatcacaataacttttctttgagaccaagtctcactctgctgcccaagctggagtgcagtggcccatctcagctcactgcaacctctgcctcccggattcaagcaattctcctgtcttggcctcccgagtagctgggattacaggtgctgcaaccatgcctggctaatttttgtatttttagtagagacagggtttcacatattggccaggctggtctcgaactcctcacctcagatgatctacccgcctcggcctctcgaagtgctggaattacaggtgtgagccaccatgcccagccagaaagttttaaggctatgattattagaccatcacacaaagtacttaaaaagtctcaggaatgctgtccctcattgggaccacaacacccagataattttttttttttgtagaaagagaagccttgctatgttgcccaagctggcctcaaactcccaccctcaagagatctgcccatctcgacaaccagagtaactggttctacaggaaaataccactatcccatgataattatattttattaagttttatttgcatagacaggaggtcttgctatgttgcccagggtggtctcagactcctggacttgaacaattctcccatctgtgccatctgtgcctcccaaagtgctcccaaagtgctgacgccacaggcataagccactgcacctggcccgacttaagatgtctttaatctagcatcccatacttcatataatcaggaaaagcagtagtgtttttttttttttaattacttagtatctcaacaagaatcaaccatctctcaccattgccaggaccctggtcagaaccactatcatctcctacctggatgttgccacagcttggcctccgtgcttctacccaaatcttcccacaatctttctcaactcagccaccatgggatgcttttaaatcaatagacagttcgtgtcacctctctgctcagaacccttctgcatctcccatctcagacagcataaaagccaaagccccagcaatagcctcccagggcttgcacaatctgtactgatctgagtcccacaactccctggcctcctcccctaccttctctccccctctctgctcgacaatcctctttcctgagcttcagacacaccacggagttccctcttagcatctttattctgttgtttctgcctataatgctcttccctcagtaccttggccagctccttcccctccttcaagtctttgctcaattttcacttaggaggccaaccctgaccactctatttaatattgctatgtgtccccattcctgccatgctcactcatttctttttactttttttttaagatataatctcgctgtgtcactcaggctggggcaccatggcacgatcacaacacactgagacctggaactcctaggtcaagaaatcgtcctgcctcagcgcctctagtagctaagactacaagtgcatgccactacacccgctaatttttttttcccatgtagacagggtatcactttgttgcccaggcttatcttgaactcctgggccagagcaaccatcctgcctcagcctcctaaatagctggaattataggtgtgggccactacccctggcttcatgttcatttcttcttgctgctgttacaaactaccctacgttgagtggcttaatacaccacaaatctactacctaacaggtctgggggccagaagtccaaaataggtctattaaggctaaagtcaaggtgtcagcaggactgcatcccttctggaggttccagagagaagatgttcccttgcctttcccagttccaaaagccacccctattctttgcctcatggaccctaaatgcatcttcaaagccagaagcaaagcatattcaaatctccctctgtgacctgtgcttccatcatcaaatctccttcaattctgactctcttaccccctctttcacttataaagacctcttgtgattgctggacacagaggccggggctcacaaccataatcccaacagtttaggaggtcaaagcaggagaaatgcttgaggccagaagttcgggaccagcctgggaaacacagtgagaccccccccctcaattaaacaacaaaaagaaataagagaaaattagctgggcatggtggtatgcatctgtagtttcagctacttgagaggctgtcgtgaaaggattgctttagccccagagttcaagaccagcctcggcaatataacaagatcccatctctacaaaaaaatacaaaaatcagctgggcatggatggtgtgcacctgtagtcccagatgcttggaaggctgaggcgggagaattgcttgagcccaggtggttgaggctgcagttagctacgactgcatcattgcactccagattgggtgaaacagagactctgtgttcaaaagaaaaagaaaaaaaatacacatttggtttctgcccctcgtcctggcacagagcttctcaagttcttataaaggccttggtgataaaggtgataggaccatcttttgtttgaatatttggtcttagtcccaggtttctaacacaagagcctctaagacctttgggatcaccatagtaagaatgcatttggtgatgttactgagatgactgggtgactgaaagctcctagacagcttaagaaaaagggctggttgccagaagaacaaaccatgtgattagaggcttggaactgtcagcctcacccactgggctccaggaagaaatagtggccgaagactgacttaatcaccaatagtcaatgatttcatctatcatgcctgcctaaagaagccttcataaatgacctcaacaaccagatttggagaatgccggggttgctgaacacaagggagataacaggaaggtaacacgcgcaatagagagcatggaagttctgcacccctcccgacctcccgacacaccttgccctgtggtttttttttttttgaaacagggtctggctctgtcccccagcctagagtgccgtggcacaatcgtggctcactgcgacctatgcctccctagctcaagccccatctctcatcctctcacctcagcctcctgagtaactagaattataggcactgagtagccagaactatagatcactgcacctggctaatttttagaaaaacctttttgtagagatgcgttttcaccgtgttacccaggctggtcttaatctcctgagcacttaagcgatgctcccgcctcagtctcccaaagagctgaaattacaggcatgagccactgtgcccagcatgtacatctctttcaccggctgtttctgagatatagcctttaaaatgaaccagtaaaagaaagtaaattggtgagatgcagtggctcacacccataatcccagcattttgtgaagttgaggtgggaggatcatgtgagcccagaaatttgagaccagcctgggcaacataacaagaccccttctctacaaaaaataaaaaaacttagccagatatgctggtgcgggcctgtagtctcagctatttgggaggctgaggtgggaggatcacttgagcccaggagtcccatgctacagtgagctttgatcacaccactgcattccagtctggcaacagactgagaccctgtatctcagaaaaaaaaaaaaaaacaatctgtttttctgagttctgcaagctgtccgagcaaatgattccacccagcaacggggtcatgaaaccctgttttctaactggtcggtcaaaactacatgtaacaacccaagacttgcaattggcatgtggagtgagggtacactcctgggactgagcccccatcctgcggggtctgcactaactccagggagtgtcaggatggaattgtgggatacccagttgggatccagattgtctgaaaatcagtgtagaaactccacatgcacatttggttagaggtgtttaaccataactactattcacgaaaaaggtctactcattacaactgaaaatcataaaattgtaagttctacaaaaataagtcaaccttatctactgcccagtcctaccaaactacagaatgtgagaacagaaggtctgaccgtggactcgagagctgacattaggaatgtcaccaccatcctgctctccaaggactcctcatcttcaacaaactcctcatcttcaatgggcagagtggaaactgcaacttgtgccatgatccttgcacaagaaaagtagtaagaaagtgagtggtagaaatccagtgtcctaaactcacatccagagctgtgagagcttttccaccggctggataattcacagttttcttgaatcaggggaaaaataagactcagaaactaggaattcgttttgcccaaaactctcatcagatagagaatccatccactaactttctgtctagtattatttccataagttagatcagtatcactcccaaaacaaatgcacatggcacccagaatctgcgcatttctcccaagtaaaagaggaggtggatgggcgcagtgtctcatgcctgtaaccccagcactttcggaggccaaggtgggtggatcacttgaggtcaggagttcaacaccagcctggccaacatggtgataccgtctctactaaaaataaaaaaaattagccaggtgtggtggcacgtgcctatagtcccagcttcttgggaggctgaggcaggagaatcgcttgaacccaggaggctgaggttgcagtgagcagagatctcagcactgcacctgagcctgggtgacagagtgagactctgtctcaaaaaaaaaaaggggggggaggaggcaatgcactttacaacccagtgatgggctaccacaactcaacacagcaaagaggtgccaagctccctttctcccctgcacaacccgacacagaagagttggtgcagtggaatgaggttgaatggagagaagttcctcttctttccatttttttttttttttttttttgagatggagtctcactctatcacacaggctgggtgcagtggcgcaatctcggtcactgcaacctccgcctcccaggttcaaccaattctctgcctcagccttccgagtagctgggattagaggtgcccgccaccacacccagctaatttttgtttgtttgtttgtttagtagagactgggtttcactatgttggccaggctggtcttgaactcctgaccttgtgatccacctgcctcggcctcccaaagtgctgggattacaggcatgagctgctgcgcccagccaagaagttcctcttcttactgagaaaatggatcacagggcatcaagtaacacataaaattctttataataagcagtattatttttggaaaacctttcctaatattttggtatcagcaaaaaccctcagattaatttcaaacactataaaaatacaatacataaacagaaaatattaactgtcagcaatgctatagagaaattggaagctgtatgcattgccttttggaatgtaaaatggtacagcccactgtggaaaatggtttagcagctccttaaaaatattaagcacagaattatatgatccaccaacaccctttaagtgtatatacccaaaataactgagagcagggactcaaacaggtatttgtacacccgtttaacagcagcattattcacagtggccaaaaggtagaaccaaccctaatgcccatcagtaggtgaatggataaagaaaatgtaatatatacatacacagagtattattcagccataaaaagaaaaatatctggccagattcaggggcttacacctgtaatcccagtattttgggaggccaaggtgggcaggtctcttgagccccgaattttgagaccaggctggacaacatggcacatttggtcagaagtgtttgaccataattactattcaagaaaaagatctactcattagaactataaatcataaaattataaattctacaaaaacaaatcaaccttatctaccacccagtactacccaattacagaatgttagaacagaaggtctcaccatggactcaagagctgatatgagcaatgtcaccaccatcctgttctctgcggactcatcttcaacagactcatcttcaacggactcctcatcttccacggactcctcatcttcaatgggcagggtggaaactgcagcttgtgccatgatccctgtgcaagaaaagtagtaagaaattgaatggtagaaatccagtatcctaaactcacatccagagctgtgagagtttttcactggctggcaaattgtttctttgcatcagagaaaaaaacaaaacttggtaacttggtattcgatttgcccaaaactctcatcagatagagaattcatccgctaactttctatctagtattatttccatgaagttagatgaatatcactcccaaaataaatccacgtggcaaccagaatcaatgcatttctcccaagaggaggtggccaagcgcccacatctgtaatcccagcatgttgggaggccgaggtgggtggatcaggaggtcaaaagattgagaccatcctggccaacatggtgaaaccctggtctctaccaaaaatacaaaaaatagctggatgtggtggtctgtgcctataatcccagctacttaggaggctgaggcaggagaatcacttgaaccagggaatcagaggttgcagtgagccgagatcgtgccactgcactctagcctggtgacagagcaagacttcgtctaaaaaaaaaaaaagaaaaaaacagtaaaatacaaaatgtctttttctcctaaccttcttagccttctgctggtacttcaatttctgctggtactgtttggtcattgccctctaaagaatgatggcttcctaaaaagaaaacaaacaacatataaaccaataaaaactcacattgaaagataaaaaataatctaggtgacgatgcaagcacttttaagacataataggccaggtgcagtggctcacacctgtaaacccagcagtttgggaggctgaggagggcggatcacctgagttcaggagttcgagaccagcctgggccaacatggtgaaacctcatatctactaaaatacaagaaatcagccaggtgtggtggcaggggcctgtaatcccacctactcgggaggctgaggcaggagaatcacttgaacccaggagacggaggttgcagtgagctgagatcgcgccgctgcactccagcctgggtgacgagagtgaaactccatctcaggaaaaaaaaaaaaagacataataaacataaaatatgattctattaactctattaatccaaataacgttttctaattcagaagaaatatataacatgtctatttggtagcttaaaaacattcttttaaaatacaaatacagtagacccaagtaggcttggggacttaatattagttactctagctacatgataaaattactggatattggaatctgaagcagcacaattatgctacaagtaccatgctcatctgtcactgacacacacacacaagtgtgaatgcctgctttgctcaattaactctgtaaataagttcaggatttgctgtggaatgttccctgctttccattttcactatggtgaaagttatggaaactcgatccccataatttaagcaaagttgtacttaaagtaactcatatgtaaaaatttaagatactacctttagtgtcaaaaacattttaatccaagtaacgtaatctgcctgcttctaaaaactggcatataaagcaacagatctgttaggcagtcacaaggtaaacaggctcatcctactggagcagaagttttactcacaaatatgaaagaaataatctaaaatatcagagtgccacttaggattaagaccacaaactgcccccagtacacatcctctgtccttaaagatctgagctactaacatggaaaagattgaaaaacactgtcttcaagtataaataaaaatatattacatttcggtaagaatacattgtttagggggaagggaagcagatgctcatctattttgtcctatctgttgataactaaattcagaagctgtactaaaagtcaaacaaaagttataaatacatctcaatttttaaagagcaatgattacagtcagaaaaactcatttggtggctagtattcttgaattaaaagtgccataccaaagtgaaatctttttggttttcaacatctagctttttcatgtcacaattattttgggattcttttccacttactgcatattgtgaaaactcacctgaactcaaaactctaggtaaatctataaacctgtatctcagaatccacctttaattcatttgtaaaatacactttctctgcacacatttcctctctcttcttttaaccgtaatatttggatttagggagcatcaagttccttgactgtaaagtcaacgaaaaaagagatatgaagtcaaaagaatgggagataatgaacaagaggccagtagttaaaaagtaaaatttcaataaagaataacagttaagatggtcgttcatgttattacccaaacactaggggtttcgtccaggtcctcctgctcatcggagaaaaagccagtcactgaggtgacaagtactgccaaggaagaaagctttaacctggtgctgcggcccaggagctggaagctcagtctcaaatccatgggcttgactaataggggcaggaaaaaaatttaacaatgtataagagaacagaaattagggaggggcaggaggcatgtggtgctgtgatctggtatgtttcagttatctgatacttcctgaaggtctttttttgaggagagaactcagatacaacagatccaagtttcaagctttaacagcagggtcaattttgacgttcatccaaaaaaaacccatccattgggacaacagggccggtgtcaatgtaagcaatgattctgtagttcctctttgttctttcaaaatctgaaataaacaattgaatttatattatatgctaaatctaaagaaaatacatcttgttgtacttgaggccagaagagatagaagtaaggcagtcaagtttgggaacattataaaaaattcaaaaaaagtaataaatgcataaaacttacagagtaacaagtgctatttcagaattcttctaaatactaagtattgacatgaccttatcaatatttgcattactaaccatacaataagaacctgacttctgactgttctgagataagggataaatgtgtactttaccttaaatgggaaagtgcatcatgtacccacttcgagattcacaacagggaaaactgatttgaaaaattgttgcttgtgaagttcatttatatgttaaaaaaaggccaatacattttcccttttccacatagaaaaggaacactatacttataaatactaaaacacagtctgtggaatacaaggaaccaatagaaacagtatgtaggaaaatggaagtgaaaagattatacattgcaaagacttcagtagaaggagtttttcatcaacatcatcagtttcagaagggcctgctttgggatacaaagacaatacttcaacagtaactcccccaagccagacgcagtgacttatgcctgtaatcccagtaatttgggaggccaaggcaggcagtgaggtctggagttcaagacaaacctggcccaacagggtgatacaccgtctctaccaaaaaatacaaaaattaaccaggtgtagtggcatgcacctatacagtcccagctatatgggaggctgaggcaaatgtactcattttttcattcctgcacccaagaaactgcaaccaatctactctgttaagagcagagataaagggtttagactccatattacatgtgaaatagaagaaatgaatcagtttagtatgaacttgtatgcacttttggagaggaaagtaggtcaagaagccattaagatacatgaaggaaggtcaaatcttaaagaaaactagaaattcagatttatttacatagctctagaaggaagaaccaggaatagtggagaatgaatgtagaaaacatttttagtgaatgaaagcatgagatgataacacaagcagccaccaatggaacaaactgatgtgcaacagcggatttgccgtcactgaagctatccagtttccaactgttgcaggtattacagagctatcaagagttttagtaggcggctggggttcctttcagatctgacatggcatgatgccaaaatgctgtacatgttctcatctttttatggctcattttttttctctcttcaggtttcttaaccttttatctacttccctctattaataatcacctaaaccatacactcagtcttctgaagtaaatttctttatctttcacttcacaaataaacatctttgatggatgaaaacaccgcaggaaagccacctaagcagatatgacttctcaacttttttttttaagtgatttccattcatcactaattccaaacaaaacaattacaaactatcataaaattattagaaagtgaaaatgggaagcattggttaaatatgtgtttagtatgcttcaccatgtcctcaaacatatttaaaaagttaatccacacttctttaagtgcattgggggacttgctttagattaagaaatatgttaactatttcaggacactaaggaccttacaaatctgaattagctcagattggctgctatctcctcaattattttctgataaataagaaacaaacagtaaatagcaacttgcagaaaatctaccagtagtacacaagggcagccaaacttcaaaattcttgccactcaaactctagacggttactatttactaaaatgtaaataataaaaagacttttctcaatcttgtcctccagaaagaaaagccataaagttcaaacactaaccaaaaaaagggtaaggagaaacgtttatatattggcgttccttttattagtgtcttcacatacaacactcctcaattttaaacaccgctttctttcagaagacaaaaccaagacaaaatggtagaaatcaaagggttacagactttgatttaaaaggcataaccttttcaaaaatgagagctatcgatggaacacttctgagaagaaattccctggcactaggatagaggttggaaaaccatctttccaggtgctctaaaatagaatcctctcatagtgcaagagtccttctaattctaggggtctaggattatttttattattattgttacctttcccgttctggaaaaccctcaagactctgtcttgtaaatgtcaccaacccagtaggttctacagaagcaataaaagaaaaacatacccaaaataagtttcaattttgaaaacattatacacacacacgtgcacgcgcgcgcacacacactcgataaaagaataggtctaacattgactataaaactaaccaggaaatacaaagcctagcattggaaaataacagaatattgattgaaaatattatccttacagtagaaactcctataaaacagtaagacttcactaaacgaaactatacaaataacagcacaacagtaggatttgagtgctggtactttttggtaaagttttgaagctgaatacacttttaaaaataaaaccattgaaaaaaaggatgtataactggtacagcttatgcagtaaagacaaaactgaattcaaatttgtagactcctttacaaagaaaggacttaaccctacattcaaagactggtgaataaagacacatttatgtactttgtagtaaagtgaaatgccacagctttaaaaagaaaatcatttgcacatcctctgaagttagtaaagctaagtttcaggcttagatagtgggcaatcactctacttgttagtagcagtcttagccagagaagaaattactggttctaagagtttacagaataaagatgacatatttttcaagaagcaatacatttgggaggatcaaaatggagtagtattaatgtagtcaataattttaagaggatgagatccttttctagtcagatttatttattttttaaagctagtagcaaaagaaacaaatatatcagctggccagaagtaatttgtctgactcaaatcaaagagcaaactaaaaaggctatgccatttctgttttcttgaatagaaaaaagctcttaaggaaagagagagatgtcaggaactattactgatgacagtgtataacccagtgaaagcctggccatcatttcattcctatgcacaattccacatttccttgttctcagtcaaaagcaggaaccactcaaaaaccatacggagcagttgcagaagaaaacaaaattttttgttaacataggtcttacattctttagatatctaactttaagataaacggataacatatttaaaactcacgagtaagtggtcaaacaactctaacactagagatgcaattccatgaatataatagaaaacatctctcttgtcattcggtaacttagcagagaagtaagaacaccaaatgtccttcatatatactaagagatgctaagagaaattcgtaaacactgctggcaaagcaagaaaaggcagaagaacatggtttctcagattaacaaaaaatgccttgagagcatgtctgttagctttctttttcataacaaggcaactttcatctcagaataggatactctgattaatcaaatacttcccataataaaatcacaatatatactacatacaggtcataaattttcaaaaatctgatctataagatactttatctaaaactatataaaaagtaatttaattcagaaggctttttaaaacatttcagtctcaagatcctcatcaaatataaaatacacgtttaacaatcctgaaaagttggtcctgatggaattctattttatcaattctaaaaggcgggtttttccacatactacatttctgaaactggaatacatcttttataatggaggtatcttaccataggtctagactagaggagaattttcccagagaagatgtgcatctgcttctgctgtcatctgggaacactatcagcccaacaccatctgaattaatcctttgtggcaggcctttgtggaccacactggtggtaaggctgcacacccaaagcttagggtttgtggttcaaattctcagagaaatgtttctttctttctctatttagtgtcaaggttgagacttgcatgcttctttatggtcccttttctggatggtcaagttaatttctcatttatccctaggtgtaccagccttgtgggttaggtctcctactaaactccctgtcctgagtgttttttccttcttagaggtatataatgtaatagcactttttaaaaataatctatgacatcttagattcgatgaaatatggtaccttaaataagcttctcaagtctattgagtaggctccagaacttctacacaacgactcattatactgcaacctcttttattctctttaggatttcctctttaaaccgttagctttacatactgcagaccaagagcaatgttgtactgtatttctacaaagaacttaattaacatgtacagtaaaaaagtcagaaaataaaatgtctagttataatttatttcttcaaattccaaatacttataatggcatatacatttctagtttaaaaaacaaacttttagctttttcctcaaagtatctgaaatcctaaaatgtagaaagccaagttagtttttagagaagacatacatgatttgactcccaggacaaaaaagtaaactctgtactacttagttataacaattctacttaaaacggcaactcaaagtactgtaaaaacaaaacaaaaaagaccaacagtaataattctacttagacctagaatagccaaaaaaaagtagtcatttttttttttagacataatcttgctctgtcacccaggctagagtgcagtggcacaatctcagctcactgcaacctccacttcctgggttcaagtgattcttgtgcctcagcctcccaagtagctgggattacaggctcctgccaccacacctggctaatttttttattttttattagagacggggtttcaccatcttgaccaagctggtctggaactcctgacctcgtgatccaccacgcctggccttacgtagtcatctttttaacaagtcattacaaattctaatttgattttgtgtctcataggtccaaatgattctgcattttaatatttcattcagtacagggcacaaaactgaaattcaataagctatgagataaataattccgtatcagagaagcatataattttcccttaaatattaaaatcctgataattgatttcattctaaaaatttaacaatgtccaatagcaatacattcaagggggaagatgccaagtacactgtaatgcaagagtaaaagaaggatatgagaaaaatgaccttaaaattattcaaagacatgttttaagacaatcctacaacccagaactgaaaaaaagccatttcacttgaccaggttgacattacctacttagcacaaagaaacttttaaggtgttctggtttacatccacttgtaggaaaggcgacccattgataatagcttacatttattaagcatgtatctccttgtttaatatctataactaccctgtaagataataacattatattatttcataggtgataaaactgaagcttagaggtgtcaagaaacttgaccacagtcattcagcttctgagataagagtggcaataccaatctattatcagctggtcattaccagtatttgttggacatttactattactgcctcagctgctatcaggttttggggaagcaagaatgttaaggttcaatagaggaagatggatataaaactcagtacaaaacagttttatgagaactccacaaagggcttaggggggcacaaaagagaggaatgggtagaaaagcaatgcgttagttgacttatacaaataaactagtgaatgcttctttaaataaagagcatccaaaatttatttcctggtcaatatactttctctgatttttattcatgaaaatgttttgatgtatagaatatgtgtccgatttcagagtatgtaaaccccgcccccctacatttatagcacacatttatgcttatacacaacacaagcataaaaccgaagttaccttgttgcatcattactgtttcaatgtagttgggataggaaggtttacgttaaacacaaaatgttcctcacatgtcacttgacttgaactgttcccatcagcaagaaaaattactgcaagaatgaaaggagttcacttttctctgtgactgttccaaagaagcggaagagcattttaagtttctccggtttccttgatcaatgtccctcaaacaacctaaaggacttaaaaaataagagaatgaaagatgagttaaaatgccttaatgattcagaaagctacatccatattgctaccaagtaacaaaaagaaataattgttccagaagacaattctgtaatgataagaactagaaaattggtttagattcaaatggcatctggagagaactgaaatcaactagaaccagccttctttaaagctgttcaaatcagacagcatttgctaccaaccacatttctccaacctatcttccaccacagagaaggcaccatctagccctcccagtcaattggggtcagtcagtgcacagctactttctcaatggctaataacatttataattcataatgttactacgtagtttgataagtaacaataacagtatctgaaaaaaatccttatctgagtgtttttgaggaaatgagagtggaggggaatgggggaaggacacaggcaggtataacaagatatcagggctcaacaatccttgttaattaaacaactagtttcttttacggactgaacgtttgtgccctctcaaaatgtatatgttgaatctttaatccctaatatagctaaatttggagacagggcctgtgaggaggtactaacagttaaatgaggtcatggggtgggactctaatctgatagaactggtgtcgttttaagacaaggtgagactacagtactctcccctttgccatgtgaggacaagatgccagccaacctataagccaggaagaaagccctcatcaggaaccaaagcagcagcaccctgatctacagcttctagcctccagaaccgtgagaaaattaagccacccagttctatggtattttattatggcagcccaagctgactaatagagatcctttgcacggtaaccaaaacagtgcctaccctgtgtcatctagttttcagcaacccggacttggattacttaattcagtttcctttgaaatgatgtggcattgttattggtaacatgtaattcagtttattctgaggaaagaaaagcagggctttaaaagcattatgacctgagtaagtagttcactaaaaaatttgtaacacaaaagcatgcttttgagtatgagatctagctttccaaaggcatttagaaattatagagactcagtggctatgaatgatgaggtactcttcatctgcctctagccatgtgctctgactttaaaaccagagacccttcaagtaaagtccacgttagtaagtgctgaaatgggtaattatttttcatgattacaacagcaagcttatgtaactacgctgagagggaaaagttaattccatgagaaaatcctattgagcgactgaaataaattaggaaaaggaaaggaaatgcagatttcaaatggttccgttttcaacgatctgaaatctgtattcaaggccaatttctggaaaaacaatttatgtgaatatttatttcctagaaagaatactaatgtaggctagtattttaaccaaatctaaaatcagatctcttttttaaaagtttaagacagcctgtgtgataatttttatttatttaaaagaatctgtcttctaaaatatttaatacacatactcttataatccagttgctagttgaaacaggatacaggttaaataagatagtatttctaaatggattctgaacggattaaaactcaataaaatggacattttattgagtgaatggagagatctaatccatctggcaagtcagttaagagagcttctgctgccatttttattgacatgtaatagtgtaataaactcacatgtaatactgtaaagctctgtaaaaaaattttaacctagcctatttgtttaaaggagatgttaacaattcatgctcccttgaaccacttcatttttgcttttaggacaggactgttcattaacacacacaatcaattactaaacacaattactgaaataaatattatcaagcagtaaccaaaaaattcaacgtaaggctatcatacccaaactccaatatccagaagccaatttaagtaacccatgcctccttggcgaaagtgtatggatattaccttttccttgtgatagtaaaacctatccattttcttacatcacccaagtatcagcttttacgcttctacaaataaagcagacaatgaacatactgtgtagaaatcttgagcccttaattaaaaggtactcacagagttgtatctaaatcattggctacaatgatctaaaacacacacacagttatagctaggtcatttgctacagtgatctaaaccacttcatttacatcttagtattaatcacaggacaaaaacgctaatattttcagaactacagccagtgttgctatctggcacaggcaacgtgtcttcaaaaccccatgatactatgtgtttgcccccaagtaaataggagggagatccaggcgccccttccaaaagcaacagcttagaggagagaaggaaaatcaaagatactgagacgattcattttagccaaaagcgaacctgccacccccaagagcaaaaaacaaaatctgaaaactaagatgtatgttattatatgttattcacagaacttatttgcaatatttttaaagaaaaaattacaaaaccgtgtttctcaaaatgttacaataaaattttatgtgtgtaaagtctatctattttacgtgtacatttgtgtgtgtgtaaaagagaggggattatgaataaggaagcgtatgtaccaaaacattagaagtagttatccttgggtaatgagattatgattttcactttcctctttataccttaatatatcatctccaaatttacaatcagaattcattataaagctattgcatttttatttatttatttattttgtgagacatggtctcactctgtcacccaggctagagagtgcagtggcgcaatttcagctcactgcaacctcggcctcccaggctcaagcggtcctcccacctgagcctcctgagtagctgagaccaatcaaagttaagttttcttcggtttaaagtaacttgttataattatgttgtttagcctcatggtaaccagaaaacaaaaatcaacagacactctaaacataaaaagcaaggaattaaaacactaccagaaaaaattacttcactacaaataaagacaggaagaaaggcaaagaggaaagagaagaaataaaaagagatcagaaagaaaagaggaagggagaaagaacaaaagaaaaagtagcaaaacaatcaagaaagtaaaaaatggcagtagtatgtttttatctataataatcttgaatgtaaattaaattaagacagagtggctgaatggattaaaagacccaattatgtcctgcctacaaggaactcagttcacctataaagacatacacagacaaagtcaagggatgataagagatattccatacaaacggaaacaaaaaaagcaggagtagctatacttagataaaatagcctttaactcaaaaaaagaaaaaataaagataattatataatgagaaagaagtaaacagccgttaagtgcatatgcaaccaacactcaagcacctaaatatagatgcaaatattaacaggctttaaaggacagagggactgcaatacaataatagagtacctcaacactccaccgtaatcaacaccccactatcgcgaacggacagatcatccagacaacaaaacatcatcagttaaactgtactctatacagaatggacctaacagacatttacacagcttttcactctgcaactgcacaatgctcattctactgagtggcacatcgattattctacaggacagactgtgttaggccaaaaaacaagtcacaacactttttttttttttttgaggtggagtctctgtctcccaggctggagtgcagtggcactatctcggctcactgcaagctccgcctcccgggttgacgccattctcctgcttcagcctccggaggagccggccaccacgcccggctaattttttgtatttttagtagagacggagtttcaccgtgttagccaggatggtctcgatctcctgacctcgtgatcccgcctcggtcacccaacacatttttaaaaactgaattcatatcaagtatcttttgtgaccacagtcgaatagtattaaaaatcaataacagatagaactttaaaaactgtacaaatacatggaaattaaaatacacacccatgaacaaccaataaaagaaacgaagaaaacacaagggaaattaaatatttattgaaacaagtaagaatagaaacacaacataacaaatcctgtgggatgcaccaaaggcaattctaagaggaaaagtgtatagctataaatgcctgcatcagaaaagtaggaagatctcaaatagcctgacagtacacctccagtaatgagaaaaacaggaacaatcaaatgctagaattcgcagaaaaaataccataaagattagagaagaaattttaaaaatagaaacaaaaaatacaaaaagtcaatgaaacaaaagctggggtgtttttaaaaaaaaatcaaaattgacgagttttaactagatgaagttagataagaaaaagaaaacaaagtcataaagaaggcattacaactggtaacccagaaatacgaagcattaagagattactaaaaacatcacaaacaaattgaaaaatctggaagtgaatacatttctagacacataacgaattcccaagatagaatgataaaaaataaaaataaaaaacctgaacagaccaataatgagtaatgcaattaaagcagtcataaaaagtctcctggcaaagaaaaacacaagaatcatggttttcctgctgaattaccaaacatttttaaaagagctaatatgtattttactcaaaatattccccataaaatgaagacgaagaaaggcttcgaaacttgttctatgaggacagcatgaccctggtacaaaaaccagaccagaacacaacacaaaaaggaaaccacaggcaaatatccctgatgaacagaggtgtaagaaatcctcagcaaaatacttgaaaattgcatttgacaacgcaataaaaagatcatctgccatgatcaagtggatttcattcatcccaggaatatgaggatgattcaataaacacaaataaataaatatgcaacatcacattcagcaaatcaacaacaaaaaccatataatcatttcagtagacgctgaaaaaattaaaagtcaacattccttcatgataaaaactcaacaacatgagtacagaaggaacatatctcagtgcaataaaggccatatatgacaaacccacagctaacataatcaataaggaaaagttaaaagctcttctcctctaagatctggaacaagtgtggctacttttacaccacttttgttcatcataatactggaagtcctagctagagcaattaggagaatgcaataaaaggcatccaaattggaaaaaaggagtcaaattgtctgtttccaggtgacatgaacatatatagagagaaccctaaagattccacaaaaaacctactagaaataataaattagtcaagttccaagatacagtatcaaaatataaaaatgaatactacacccatgcaccaatagtgaaatatctaagaaagaaatcaagaaagctatttcattaccaaaaaaaaaaatgatatctaggaataaacttaaccaaaaaggcaagagatcccaaaatgaaaacttcataaaacatagatgaaagatactaaagcagacacaagtaaatggaaagatatcccatctctatgcactagaagaatgttaaaatatgtgtatcacccaatgtgatctacagaatcaatgcaatccatgttcaattacaagacattcttcactgaaatagaaaaagaatcttaaaattcacatggaagttcaaaatacctcagatagacaaaagaatgtggaataaaaagaaaagctggaggcatcacactacctgatttcaaaatatactacaaatttatagtaaggatggtactatcaaaacagcatggtactatcaataaaaggggcgggggagagacaagagagatgaacgaatgagacagacagacatagacaagtgaaacagaatagagaaatcataaataaattcacgcgtttacggtcaattcatttttaacaaaggccccaagaacacaccttcgggaaagacaatctcttcaataaactgtactaggaaaacccaacacccacatgtacaaggatacatctaggccattaccttaccatatacaaaaatctactcaaaataaagatttaaatacaggacctgaaactatgaaactaccagagaagaaaacataggataaatgcttcatgaaattggttaggacaaggaattttcaaatagacatcaaaagcacaagcaacgaaagcaaagatgtaattacattaaacttaaaaccttttccaaagcagaggaagcaatcagtataatgaagacagaacccgagaatggaagaaagtctttgcaaactatgcatcaggcaagaggttaatacacaaaatatctaaagaactcaaactactcaaaagtgaaaatacaaataatcttatttttaaaaatccacccaaaacttttgtcccccaccatttccccaccttcttttcccgaccgcatttcgccctctccctctcaccaccctttctcttcctccatctacccccaaacgttttcaccgttttctccccaccatcatttcgttttctccccgccccaccccgcgtcatttcgcaaagccttctctattctcccgctcaccacgcttttccccaaccatctacccaaacactttctcccgttttttcccaccgtattttcccccttctccctggccaccctcttttttccccctcctgctgtcatcatgcccttttcctcctccatctaagcaaaaacatttcccccccgtcttttcccaaagccttttccccactcctgctgctcaccaccctcttttccccctttatctacccaaaaactgttttcctcattgtctttcctcctgctcctccttgccactctttcccttctccatctacccaaaaacatttccccaccatcttttctcgaagccttctccccactcctgctcacctccctcttcccccatctaccccccaaaatttccccatattttcacaaagtctgccccctcttcccactcgtcctcttctctcccctatcctgcttgccacccttttttttgccctgcatctatcccaaactattttcccgtctttttcccaaccttctttccctgctcccttctcgccaccctctttctcctccttgtcaccctctttccctcctccatctacccaaacactttttacctaccatcttttctccaccatctttcttttctgccactgttttttcgcaaaaccttgtcttcctcccgctagttaccctctttttccttctcccacttgctatcttcttctgctcctctatctacccaaaaacttctctccccactgtcttttcacaaaaccctctctccctactgctcgcccatttcccccacctcaccactctctcctctccccaattgccaccatcttttcccccttcatccacccataaacttcctatccaccgtctttctgcaaaaccttccctcactcccgctccacaacccgtctttccacctccgtctacccaaaaccttttttccccaccatcttttccccatcgtctttttgcaatgccttctcctcctcgctatccttttttccctttggcaataaccaaactctttacccacccctctatctatcccaaaactattttcctcttcctacccttccagccgcgctgcaatcgcaatctccactgccaccaccaaccatagcgaggcgagctgcgcctctgtgccgtgtctcaagcctccagcatacggccggtgactccttttcctggtcctctaagctgggcactgagcagctcaacagtaaaacacccaaccctaaaaaaaaaaaaaaaaaaaaaaaccgtaacggctcttcagcatcatttatatacggaggttatgcgcatgccggttcctagacttcatgttctgattgcataagagcaagtcttaagataaccaatcacagcatgaaaataaagtccaatcagagtaggcctagaggtttttctctcatccaatcagaacatgtagtccaggatccgtaacttcagtatataaagcatgctgaggaagtggtgcgtcatttttgggtcttctgtgtcggtgtgtccagctgctaggtacctgggttagagaactagaagggtccattagttttcaccgcctggagcctggagcctggagcctggggcgctgcctccctgttggtggtgttggtgacggagcggtaggagggaggctagcagcaggagcttctcctgccgggctggaagacgaggagaaggaagagacaccgctgcatgctggaggctggagccagagcctgcgcctccgtggcttacctcgctgcagttggtggtgacatcagagaccacagctcggctacagtggtagcaatgtggttgcagtgagccaagattgcatcactgctctgcagcctggcgacagagcaagacaccatcttaaaaaaaaaaaattgacccagtgttttgcatgtttcagaaaaacaaatgataccattatttaatatgctgcagtaactagaagcctacttataaagttggtggcaaataagtcattggtatatgttaacttcctataatcacttacatgttcctaagagtcactttgtgtatttatataagaaggtcagcatgtaaatgagtatagatagagaaactttttgttgaaaagtaagaaagcttgtctcccttttcctagttatgaaggaaccaccaccacaacaaaataaagcatatactttgtttataaccctgaatcatgatttatggccagattatcctagcatccaactgcctaccttggcatttatcagttgaaatgagtccagagaaaggaattattttttatatatctgctgctcttgaaggagaaaccttctttagaggtcacttgtaagaacaggttcccaaatcccctatatccaaggcactctgggctgcctgggaactctacaaatcacagttttgaggggttcacttttctggttgaaatttatcatagtttatatgatgaaaggatgacaggtagatattctttaagagttgaggatgtgttatgttaccaaggattgtaaatatttaatgagaaaatgagttagagtttcaataatattgatgggacctattatcactcactttcatctaaagctcagtgttacttcaaagcataaaatcaagcaaacatcccatgattaatttagtttcttacactgctgtgctttgtgtttcattgaattcagagtatgcctgtgtacggtccctgggaacactgtatgaaaggatttttaaagtagtctgttctgatactggtttgtcaatgaaacttttcaaaaaggttagttgaatatcacttagtgttctttatgtgaccctcttgggtctccttcccagtgccaaattcccccatctcaacctcatttggacatcctatattaagaaaaaacaaagcaggtactcatcagcaggaacggaatcctattctcttgacagaattcccgtgatctataacctgctggataaatagttcaaatgctgtatctctgttcctattcctagactttctggcacctattacccttcaagtccatgtgtcttccagtaggttgcagtgctctccccaggagatggcagctacctagatttgtatgttacagaggtggtcgtgtgccttctctacctctctcctatgttcccatgtaacctaaccacacaggccataatcagctccaccctaggaaacataacattggtacacctgtcccttgaagttgtccttagagagaatggtctgaaaacaaagggagattaaaggtcttttctgtttcagggaaagtatagttctgtcagtggatttctggttaaaagacacagaagaaggaaaaaagacactcatctgtaggaactcagtttagccaatgtgacttccacttggaagcatttttcctctcctcttcaagcccaactctagggaatgtcctgtgcaaaaatatcagtgtaggcgcatctctttgcggaactgagttgctctgctttcagtttcctctctccagtgcccccaagctcctgcctggcttcttctgctgttcaacccaggatcccatgctctaggacagccttctcaccatctttcttcagctcttaattcaaaagtcccacttccagttcatgctcagagaaaaagcaagtagacctaatctttattagaatgtgaatttctagacaatagtactctctttggcttacttcactgccctacgtgctgaactttcagataatataaggaagagaaaaaagtctagatgttggagagggagtcggtttcattttatacgattcagcctaatgggctttcattgctaacattaggggttacagttgaaccagccaactcaggaggaaattcagaacctggattcttatagtgatagtggaaaacaaattcatggttaagatttgaatgtgaattttaaaataaatcatagtattttaaaaaaccattttttccttattaaatatgtaactttggaaaagttacttaaccagttcataatagtacctattttatagggctgctgtggggatttaatgagatcatttatggaaagcacatggcactgtgccacactcataataagtactcattcagtgttggccacaattctcaccagccttgttctctgtcctcaggagatgatgaccataattggaaaattgcccatgtggtactcaaagaggaacaggaatttcgctaacttttccagggcacaaaaggcgaccctcggaactcaactgggggaatttacctggatgacatcactcttgacagaaaccccctgccccacaggggtctggacagtccagaatttctcccaggtccttgagaacaccagcgaaggggacaagcttcagagccctcgattctacaattcagagggatgcggttttgggttaactttatacccccatggcagagaaagctctggctatttgagacttgctttttacatgtgcagtggggagaatgatgctatcctggagtggccggtagaaaacagacaggtgataattaccatcttcgaccaggacctgatgtcaggaacaggatgtccttaagtttggtgttcactacctccaagttgcacatatctccaggtgggtggtgttggcataaataagaactgcccctcgaaccagagaggcccacagatgtgattctgtggtgcaagaaagagtaacgttctcctcacattttccgcctgggaataccgataacataggcgtgttggagtttcaagttaagattttcaatgccatcacatcctccttccctttcctaaattcactcatcaaacatctgttgagggcttaccatgtgccaaactctgtgctaggtacttacaatacaagtgaatcaggtgatccctgcctcattgatctcattgtgattgaggaaacagatactgctaatcatttatcaaatactcggaacttgctaggctctgtgcagagctaatgtacttactcctaaaatagcactcaatatcactatgttcatgaaataaacttacatcagtaaagaaatgggaaaactatttttttttttttttgagatggagtctcgctctgtcacccaggctggaatgtaatggcgcaatcttggctcactgcaacctccacctcccaggttcaagcaattctcctattgcagactcccgagtagagaaggggtttcaccctgttgcccaggctggtcttgaactcctgagctcaggcaatcaacttgcctcagccttccaaagtgctaggattacagacatgaaccaccacacctggcactatttttttttttcaaaagagaagacctaagcctcagaagaaagaagccatagctgtccctctcttttcattaaaaaagtcacgcagtagcagacaactgatcactcagagctgtgattctctgcttctcccatctttcaattctgaattgcaattctcctggaaagagtaaatagcttaatttttttccaacactttttttatttttatttttatttatttatttttttctgattcacaaagccctgtatcctcataaaagacaaactggaaagtgaagtctaaagaggtaatgtgattttatgttacctacaattttgcagcgacaaatgacactgtcatctgggacaggccgtccagggtgggaacctatcatgctgactgtaattgttttagaagcattgactttggctggagtggtttcatctcccaccaaatgctgaaaaggaggagtttcctgaaaaatgatgacctcatcatgtttgtggactttgaaggtacttttcttggtcttcctgagtaaataatcctatgctcttggcactctactgattttatcctgattttaaagcacacatggagggtggggatgaggttaaaaaaaatgtgttgtaggagaaccacattttcttcaattggtcaaggactcacatctttattttaactgtccctgaaagaaactgaaattttagtgtcatctttttgaaaattttatcagaggtaacagttcactgatttcaatttagtttccatcagtctatccatgctaactttatgcttcattttgcaaattcaataaataaaaatgtgactggattactttaaaataaaactagctagtaccgtgggaatcagctggattcaaagccacttttccatgtcactgggggtgacatatcactagagatagaagcaggctggggaactttcaccagaagtgggagttcgctgtagtcagttactaatcctggatcttcctcgtgaccctctatttcctgaagatatcacccacctcagccagactgaagttcccactaaaggcaaaagactgagcccccaaggcctcattctccaaggccaggagcagcaggtctccaaagaaggttcaggaaaggccatgttagaggaagctgtacctgtcagcctcagccaggggcagcccggctgacagaagccgtcagtgaagaacacaggccccctggaggaccataactggccacagtacttcagagacccatgtgacccaaacccttgccaaaatgatggcatctgtgtgaacctgaagcgggtggcgaggtgcaggtaggctctgtggccggggagacaggcaggccagcagacctgggccgtgtgcatgcttatgcctggtaaaggctgctgtttgcagagtagggcgaagactacctcagatggtcagctggatgcggttttccttgactctacaaaggtgtgccctggattcatgggcttacgctgccaggacagaggcgtcccaggtctccttgtctcttgactttcaccccttttcctcctctggggtattgtcaacagcatcttggatgttgttggaatttctaactctaacaacatccaagatggcttctagcctagggactttctactccatgacagtgggtctcaagaccaagcttaaatctttgctgactacacagatgttattattagctcctaatgattattagttatacagtctgtcatttacactgcactattattaaagttatgttttcaataatagtagtaagaacacctgatatttctgaccccttgttatgcatcatgtggtctcctgagcatcttacacgcatgatctaaattcattctcactgccacctgtgacataagggctctccttatccccatttggtgtatcaagaagttgaggcttagaaaggttaagtaatttatctaaaatgtacccagatggaaaatgctgaagctgggacttgcatctaggtctgtctggcagcacagtttgctatatttaatgtttaaatattaaaaagcagtacagtttgctatatttaaatttgaatatttaaaaagaactttaatagttctttttataatgtttgcttgcataaaaccctaaaaactgtttcacaaaaggaggtatgtgatgacagaagcaacagttccatttgaacagtagcagatgtaggagctattctgcctacctcaaaaatttacattacttctgagttctttttagtctccttttttttctttttgtagcttttgctttgaaataattttagacttacagataccttgcgaaaatactacagaggctttctctataccattcaccctgctttccgtaatgttggcatattacacaaaccgtagtacaattagcatagccaagaaatgaacattggtagaatgctagtaaataaattacaggccttattcggctcttctcagttctcccactaatgttctttttctatttcaggatccaattccggatctcacgttacatttagtttttatgtctcctgtctcctaatcccctccaatctgggacaattactcagttctttcttgtctttcattaccttgacacttttgaagattactggttagggatttttttttggttcatcttgttctctcatgattaaattgaggtttcacatttgtggcaagattagtaaatatgtgctgtgccttcttgttgcatcatgtgagcaggtacatgatgccgatacatgtcattactggtgatgtcaaccttcatcatctggccaacagcatgtccaccaggcctctccactgaagagttaccatttctccctcggtaattgatacatatcttgggagagatagttcaagaccattgagacatcctgcttttcctcaaatcctcacatgctaatttcagcatctattgatacaacctgctgcaatattcaccactgggatcttctaatgttgatttcctatgtccttcacattcattaattagaattcttctgtaaagaagaatggccccttcaccccgttaatttgtttatgtgattatttatgtatatcacaaaggaatcataaacatttattttattcagtgggctctgttgcaatgatttcataatttattttgttgcttctattgtcccagctttggcctttgggagctcttccaggttggctcctgtgatctttcaacatcagattttatgaacacaatgttactttctggcaccatagcatgctctaggctcatcttttatatttcctgccccacccatagaatcaatcactcttccaagaagccctctggctccttttactggggaaggcccatctgtttctgggctccaaagccatgggtcttcatatctttgcctgacaggtccttagatgccagattccattgtgtgcccccaacacgcttcatccttcccaggctaagggaggccagggttgccacttgtatgtcagcctctactcagccaaactattcctctcctagaaacctgcagctgagagttggcagaataagtttttctaagataacagtaggggatattacgaagttgtgtttggaggggactgggtcagaaaaaaaatgaaataaacttgctattactcactgatttctaagaagtcaattctcaggatagagatgaggacttggaaggtaaaatcattcaggattagtaaaagaaaatgctgacttctttttttttttttttttttttttgagacacagttttgctcttgtcacccaggctggagtgcaatggcacaatttcagctcactgcaacttcgacctcccgggttcaagcaattctcctgcctcagcctcccgagtagctgggattacaggtgcccaccaccatgtctggctatttttgttgttgttgttatttttaatagagatgagaccatgttggccagtctggtttcgccattttggccaggctggtctcaaactcctgacctcaggtgatccacctggcctcccaaagtgctgggattacaggcgtgtgccaccatgcccagccagaaaatgctgacttctgattgtttcactctgccttgtagaattctgctgagtagaccttctagtgggaatgtttgaaacaaaggctggaatttttacaaaggtatggatgagacactacaagttatatgccttggttatgagattaattcgtctttataccagataacattaagaaacaaaactaagggctggccattatgtgcttactctgtgtcaaataccttgataggtacaatgtcctcattatctcaggtgaacttcagggcaaccttgtgagatagtgacagtacacactaaccttacagtaacattttatttaatattatttagacgttttcaagctaccactgatgctctaagtcagactgtatctggggaatttcctttgtagcttgtattcttagccagtgtcaggcaatgtattcctttaagtgtctcagaccatcctcctgaatcctaggtggctgagaagcctggatctggaggcatacctcttgggattagatttcaagtgtgaaatgcttactaacaatgggaccttgagcaaattatttaaccttcctgtaagatgaagatgatgagaatggccaagtaatagcctccacctcaaaagttgttgaagggttaaattagttggtccatatacagcacttgaaatgggaccaggcaccacgtggacctgctcagtgagcgtttgccatttttattgctgtggagatgagtgttgctaggaggcacctgaggcctgggagttcccacactctcttcatgtccttttccctcaggtgcatctctggacatgctttcttctaaatgggagcgctgtcaggccatgcagttgcacggcagcgtcctgggcatggtgattggaggcacggctggtgtgatcttcttgaccttctccatcattgccatcctttcccaaaggccaaggaagtgacctgcctgttggcattggccagaccacagcagcacctcctccatgcaggccttaccttccaatggtcagtgcagtttggggcagcttttttgtcagccttgctttggataggatctccaaggtctaaggcctccagccccatgtgtgacccttgtcatctttctgccccacataattctgttactctgctatgtgctcctaatgtatctagtgtgtcctgtgacaacattcatcatacttcattgtaaaccacttgtttgattgactgtctttcctatagactgtaagccccatgagggcaggcacatgttgttattgaccatgctggccacgtgcctagatgcatggctggcacattgtgggcactcaacaatggttgaatgaataaaacaataaatgaatgaataagatatagaaactctcatttatattgcagatcaaatatatattatgaaattcttatgttgaatatgttagaatcaaatactcatttttcattagacacagtactgtcattactcttttaagatcttgttaaagatttcaaataaaggtacttccaggcaggctggcttcacagcatttgctttcctctgagattctaagagaagccctttaataaatttaataaatattgagttagcaccttctttgtatctggtattgtatgtacgtgtgggtgtgcatgtgtgtgttgaaggttgggggtgttcaaaagctctttcccagatcttttaagtttaacagtatattttatagctatttatgtacaacattatcatattaacaaacagaaggtatcagagaactttaaagaagtatttttagatatgctttctttccatagttcctaaggagataaaaatctagctggggcaaggaagttccaagatagatcaagtgaaaaaaaaaaaaaaaaaaaaaaaaagctaaagtttctatacccaatcagcaatgagtcagctcaggaaatttaacaaacaaaaatattttaaggattctgagtggtcctttaagttataaggtttcctaagtagagactttatgacaattttgtagagttaaaatgcactggaaacaaaatgagagattaacaagagtttctttaatgcaaaggtatgagaacaatttgtagcaagtgaaaacagcacccctgagggcaatacctctcaaacttgaggtgcatctgtatcccagggaggactgattaaaacagattacagggccccacactttacaaacctccactttcagtagagcctccaggtccctcccaagagcttccgtaagtcaccacaacccaagaggaccagggagattccctcatgcagatgttcccagaccatgcatgtgatggcatgtggagggcttcccaccttgacatcttcctgtcctctgtagaaactgggtcagtagatctagggtgagatctaagaatgtacattcttaaatgtgccaggatctaacaaggtataagaatgtgccagaatctaataagttctcaggccatgctgctactgctactgactcccccacaacccccacctcacagacaccttgagaaccactgctctagtggatagaaaacaagtctggaagccaagcatcctggctgcaggcttggattgcccatccagctggctgggtaattttagtaagaaatcatttaagctcttgatcttagtttactaacttgtcaaatggaaataatagctgactatctccttccacatgactttactacttacagagtagcagagtaatacaatgggataatgaatatgaacctatcttagagtttaatatgtatgaaaatattactattcaatgttcagactagataggaagctatcctgtcaccagcccagttgtattatctccaaagtccagattggaaatggattccagctttgtttctcgctgtgcttcacagtcctgcaaaccctccactaacctcatagttaggcctaaagaaagctatgcccttaacactctgctgagtatctgacctcagaagtgaactctaggctttgttgctgctgctgctgttattgtcctttggttttattaaaaggaacatgctgtggtctgtctcacatggaaaggtccctagcccaaaccaatgacaacatttcttaaatatatgagtttctctctggaagaagcagaagctcaaatttcaaagataacctagtattttcatctagtactgcaaattaaaactgctaggtcaaaataatgataaggaggtaccagaatgagggtaaagcattttgatatttatttctctctagattctcaaccagtaccatgcctactatctatctttatcacttttggtgattaatggtcacctcagttgattaatgatctggctcaccataaatctgacatggtattcagcttttctttgagcccaaaccctcaatcattccaggaggactagcagatactttattcttttgaggtgttgggatggtgatggcaaagtgggcatgtaggatggggagtgggtagaaattaagcatttcataatctctaggcagtatggaatttgggatttagatgagcaacatgaaaaatgtgggaaatcctccctgaatctgagtgtctgacttctttaatcttacatagtgggaataagtcatagtggcttgaaattttgaaaatgtctcatgcttcccacaccatatccttgatacatccccatctgcatcctttccttctgtgaactgagctgagccaatctggccattcacaaatgtcaggttctttcagtaatatctggagcctctgataattagaagtggatgggaactctaaccccctctctgattatgttaaaatgaatcaagatttgaactaaattctgctacacattcatatttgttaaccattgttgtgggaagtcagggactctgaacggagggaccagctggagctgcggcagaagaacatcagttgtgaagatttcatggccatgtatcagttcccaaaattgctacttttataatttcttacgcctgtctttactgcagcctctgaacataaattgtgaagatttcatggacatttatcacttccctaataatagtcttataatttcttatgtctgtctttactctcttaatcccattatcttcataagctgagaatgtatgtcacctcaggaccactattgtacaaatagattgtaaaacatgtgtgtttgaacaatgtgaaatcagtgcaccttgaaaaagaacagaataacagcgattttcagggaacaagggaagataaccataaggtctgactgcctgcagggtcaggcagaatagaactgtatttttcttcttgcagagagcatataaacagatgtgcaagtaggagagatattgctgaattcttttcccagcaaggaataccttggggaaggaatgcattcctggggggaggtctataaatggccgctctggaagtgtctgtcttatgtggttgagatgaggactgaaatattccctggtctcctgcagtaccctcaggcttactaggattggaaaattccagcctggtaaattttggtcaaactggttctctgctctcgaaccctgttttctgttaagatgtttattaagacagtatgtgcacagtgggacatagatccttatcagtaattctaattttgcctttgccttgtgatctttattgccctttgaagcatgtgatctttgtgaccttctctttgtttgtacaccccctccgcttttaaaatcctaataaaaacttactggttttgtggctcaggggacataacggacctcccaatatgtgatgttacccccagaggcccagctgtaaaattcctcctttgtgctctttctctttatttctcagaccagccaacacttagggaaaatagaaagaacttgcattgaaatattggagtctggttcccccgataaaccaacaaacccacaaatagccatccaacctgttttgtatgtgtagggaagtctctgctctgtccttttaagtgctccagcaccaagcctcttggattaaaggttcattctacacacatgcattcaaataatctgaaggccaggatcagtcaactctctaccctagggtttctgaacctcagccctggtgatattttgagctggatattcttttctgtgagggctgttctctgcattgtgatatgtttagtggcatccctggcctctacttactttatgctcatagcacacttccccagtagtgacaatcccaaatctctaagacattgacaaatgtcccccaaggggcaaaatcattactgattgggaatcactgctctagttggatgagccaatgaaaacttgtattaagtgagtgaaaactaggaccaaatagagttctagtcaaaggttctaccccaaaagttagttcactgggcctgccaaagtattgtacctatagctatcttgataattgtatttaaccaatgcaaaaattattttaagcatcctttatactaataacaaaccctctggtatagcttgctatagaaatatttaaagttttgcaacagatatttctccagtagagacttttgattaggatctttcaaatactaactaactgctattggagtgtgtattccttttcagaatactttgcatactatttaacctcccccagggtgtggattatagtccccctgcaggctgtatacagtgtaatacctatatggagacatttacaagcaaattacagatgatctcacaccttcccttcttgagctcctcctttctcatgaattatatcatctgttttatggcttgatgaaatttttagagattctgaagtccacctcttgtatttgggtaaactgaggcaattctggagaggctaagtgccttaggcaggtcacagagccacttaatagcagaatctattattcttgtttgactacagaaaaccttaataagattagaggtttggaaggtgctataaaatataggcaaatctatattgaacactatgtaaaggtcttttttacttggtttcccttattagggatatcaggtttatggatgatttgtcacctactcaaatttctatatgtttataaatatggctaaaacatctttcttatgccaattttaatataagtatgtttttcaaaagtctctaagcaaagaaaagtttgaaaagatttatagttatcctgtagctgtgagtgtcatttagcagactcttgaaaaccctaatgaatgggggatgggagataatggagtcaggtgccagtgacctctaatgagtactgatgtgaaaaaatatgataggaaatatttgatatgggtaaggcagcctaacaggatgtgtgtgtgtgtgtgtgtgtgtgtgtgtgtgtaagagttgcagctaacagtgatatcagagtaaagacaagacccatctctctttgccttccacaattttaccaaggactagtcctggaatcccagaatggattgagacatgggcctcatctgggtcacagcatccctcagggcctagacaaatttaggacaaattgacccatgtgtggctcaccagctcaatgaaaatcattaaaaacatttaaagatcctatctggtcaagagaataaagggagaatagaaaaatggggtcataagaaaggtatgagaagagagcaggaggcagaggagatgttcagatatcagcccccaacaaaaatggtcaccaacatccattcttcttttctcagtaatagaatccccaaactccaactggtcaaatggctactcagagtctagtttaccttctcctgcttcctttgcaggtagatgggtgatatggtttgtctctgtgtccccacccaaatctcatcttgaattgtaatccccacgtgtggagggagggaactggtgagaggttattggatcatgggggtggcttcccccatgctgttcttgtgatagtgagtgagttctcatgaaagctgatggttttaaagtgtggcacacctccttgttctctcacttttcaagtcttgctaccatgtaagacgtgccttgcttccgctttgctttccactatgattgtaagtttcctgaggcttccccagccttgcagaattgctagtcaattaaacctctttcctttataaattacccagtctcaggtagttctttatagcagcgtgaaagcagactgatacagtgaggtagtgtgatcaaattcaggccagtggaatggaagaaggaatgttgcatgtgagcttctgggaacctttcctaaaggagtcttggtgcacacctgtagtcccttcttctatcctaatgactgataaggggatgtaatggccagagtgagagctgccaaatggggccacgtggtgaccttggcaaaagcagattaaaaaaatagaaagtatctggatttctgaggactgcaccgagccaggctgccacaccagtcttgggctgcttatctgtgttagagaaataaacttctactttaagtcgctattattttgaatgtctggcattcacagaaaacatgatcctaatggatataattatttctatggggccagcacatggctcagactaagccaatcatgataccctgtactgccacatatacctgaacatttggagaagaaaagggttagtcttctcaatctatcggtctgtggacctcataaattcctctccttgaagatctaccttggaatgaaataaatacacaaagagaggcaacaacacaaaaggaagagccagaactctgagaacactgtttgggcacctgaatctagctgtacctgaaggtgtaccaatctactatctttcccagttacgtggtaagtgcccacttttgcttaaactaatttgattgtggttctgttacctgtaactgagaaagccttaattaacaccactgttatagtgcataattggctcatttgtaaagaaaagaaataatgaaattagtttgaagattaaataaaattatgtaatatgtaagattaccaaaactgatttgaaatgcagacatggggtagttaaccaggctcacacacttgttatgtgaattactcacccattctggcttcataatgagcacgatttaaactcaaaccttgataaagttatgatttaggatgtcacgtacctttgacgttactctcaaaagctcttaaccatgaattaaaagtgacaatgtgaaaggcatatgtagtttgattctgaatagaactggcatctaaatctgagttctgtcaagatctatcaagaattctgagtgttggatattatttagacacataggaagaaagtatgacttctcagaaatgaagtgtaattctgaggctgtgtttaaatatatcaggaggagaattgaaacatttgctctaataaatttggctaagtcatgatgcatgatgtatatatgtgtgtatgatatatatctactatagtttttatgcacacacggtaagatgcaaaataataaaggctaactttattcagcaataattgcaagccagatatgattttgtaggctttataagaattttacaacaacccatggagcatgtaccattattatttcctttcacatagtgtaaattgaggcagaaagagttattttaccaacagtcaaactaagaagtggtggacctacaactgaaaagcacacagtttggctctagaaccaatgctgttaaccaccataccacatttgccaaactggctgtcaatcaatgctgaagaacagcccaatacccctgtccatgcaaaatgaagcagagaatgcaaagcattcaagtagcaaatcagctgctgtttcagtctgcatatcagaaggaaaatcatgacttagctaaacgtattaggacaaatgtcccaattctccacttgatatgtttaaacatagcctcagaatcacgcttcatttctgggaagccatattgccttcctacatgtctaaatgccatccaacacgccgagaattcttgatagatctgagacgaaaataaaaacaacactggtgattgagaccttacaagaagctcacttgactgaagactcaagctgggggggtccactagataactaagttgagatctactttcaataaagcagcacagcaggaattctttgatgtttcaccagagacttaaaaaggaagtaggcgcactctgaagtttgcccagaacattggtcattatgtcctgggctgccccaaggtagaattataaagtgagatgaagcttggggaagccttaactcctccaacctctctgtcactgttgttctccctctcattttttgcatttgaaactcttcctgctacggaagcctacttttaagcaagtaactggcatcaggttgcatagagaagcaatataaggtggtggatacatgcccatgttctaggtcagacactgcatttagatcctgattctactggtcctcagctgtgtgactgtgggcaagttatttacctctctgtgcttagctttttcctctaaaaatgcaaagaaaaagaatatttagttacttttggtttgctatagagtttaaatgagattatacgcataaaaatcttagaacagcagcaggtacacagaaagggctcaaaaaatgttggttaatatagttatatagttaccagccattttcattcgagggtaaatttaagttactgtgtttctcacccagaggtgtatttgcataccttttctctccttgagattaacctgagattaaccttcttaactttatctgtctttgagatttctgtttttgtaaaaggaatgtccaacatgaagaagaaggtgtgagagctattccgagggtataggagcaacaggccaaggtgcgtgacatccccccaaactgggaagctgtctgcctcattactgaaggccagttcagcttgtccctctacaccaaggaccaaccctgctggcagttggccctgttgacttctcctgggtcttctcgggtcacacgttagcaatgtgtgctcagaggataggaacttgccatccagcctcagctgctggctggactgtcagattgccctgggatagctgcagattcatctgcagattcatgatggattgaaaatgaaactccaggccagcagtggctttcaatggatgaattaggaaagggaataggaccacctatgttaatccttttgcagctgccttgatggaaaaagtattgggttaacatgaaacatggaaggcacccatttttcttcctcaaacgaccttccagcagcctatctggaatgggtgaaccagatcttttctggggctttcagctttgctgttagtgccataaatgagattcagtcagtaagagggggacagagaaaggaaggagctatctcagcgagtatgcctcagaaatgtatgcctgcctgcagatgtgctatgcacacttgtaaaccagtctctgagacaggtctcaatcaacttagaagtttattttaccaaggttaagaacatgcctggaataatggaacacacaatcacagagacagcctgtggtctgtgtctttccgcaaagatattttgaaggtttcagtatttaaaggggaaaagtggaggcgaaagagggaaggtatggcaacatggcataatccatgcattgcaggagaaaaggagcaggtaggaaaatagtcagtgatgtattcatctcagtaaatcggtactttacataaaaggtgaacctagtgtagctctctgtggagatatctggcctttcatctgttagctatttgcttagcaatagaaggaaaaggctgtttcttgcatggctcagcttccatcttaattttttcctttttgcatagtgattgggggcccgaaatttcctttgcctttcacacactgaaacgacgtgactgggatttccctccctccacagtcctacgtggctttctgactaccctttcccctgtaaggatcataatatgaaagttaggaggctggagtgaaagagatttttttcatttctggtttctgttatccactatgccttgaccttcgctctgcccatatgatcaaatgacttcctgaacgtagcccactgggcgcgtcatccgcgggactgactctgcctcccacgggcttcctgaggccggaccgccgcggggacgcctcctctcacgcccaccaggggcgcgcgagcctcaggagacgccagcaggggttgcggagctgcggtgctggaagccagctgtcactccaacccagctggagattcctgtcgggaatgcttgggataggacagctgtgagggagcccctggggcataggaaaaccctcacagttccagaaaaaaacagaaaacgcatgcacagtttttctcggttaatcaaagtcaaattccttttcccacaactgctggggtgccagctggctggcaggatggaagaaccaggatggcaccaatcaaaatccgaaaaaggcagggtccaaagtcattcctgggttttgttgtttaatgtcatcggaagtgggccgtgacagcaatctgcccaccacttgcccattcaggtcctcttgcctttcatactgagaataaagccatttttccccccgggctcctgggtttgttctgtttaggcttcaatagtcaccggcatccttcacatggctctgcatgacagaataaaaaccctggggtgggaacaggctcatgtatctcctaaccatgccaccatgtgtgcagagggacctgtcatggacactggtggcctttcaacttcatttcaaagtttacaggtaaaaggggaaaaatgggtgtgtataaaatcatttaagaataatcccagcactttgagaggccgaagcgggtggatcatgaggtcaggagatcgagaccatcctggctaacacggtgaaaccccgtctctactaaaaatacaaaaaaaaaaaaaaaaaaaaaaattagccgggcgtggtagcgggcgcctgtagtcccagctactccggaggctgaggcaggagaatggcgtgaaccctggaggcggagcttgcagtgagccgagatggcgccactgcactccagcctgggggacagagtgagactccgtctcaaaaaaaaaaaaaaagaatagacaggacggttgtgtctgaatcataggacaccacgaccaaggcccccacgcccaccccggacacgtacagatgatatttggagatcagaacttgtgtctggcatagagcggacttcgggagttgcccatctcccctcttttcttcttctgtccactaacagtgggaaacttggtttccgtctagaatgtgctagaggataaatagagccctcacatcctttatattaatctataggacatgagggctctattttcagctgtcaatgaaaatttcaagccatcctcacacaaatgttggaacaggcatctgtttgttcgccagacaactggttctgaaaactttacttcaaggacccttgtttaaaccttctataacgtgctggatctttgcacacggcttgggagtgcggatggtgtgagggaagccatcagacctgccagccagttgagctcaggggcgagctgccggcctcccccatacctggaagatggaaaggatcgttcgctgtttggagaatagagctgcattctgggtgacatgcagaagcctgagaggcagcagcaccacattgcaagaaggcaaacaattgctacagagacagtgttgcgggaagtcagggaccccaaatggagggaccggctgaagccatggcagaagaacgtggattgtgaagattttatggacatttattagttccccaaattaatacttttgtaatttcttatgcctgtctttactgcaatctctaaacataaattgtaaagatttcatggacacttatcacttccccaatcaatacccttttaatttcctattcctgtctttactttaatctcttaatcctgtcagttgaggaggatgtatatcgttctaggaccttgtaataattgtgttaactacacaaattgtacagcatgtgtgtctgagcaatacgaaacgtgggcaccctgaaaaaagaagaggataacagcaattgttcagggaataagagagataaccttaaactctgaccgccggtgagccgggcagaacagagccatatttctcttctttcaaaagcaaatgggagaaatatcgctgaattctttttttcagcacagaacgtccctgagaaagagaatgcgcacctaggggtaggtctctgaactggcccccccagggcgtacctgtctcttatggtcgagattgcagaggtgaaataaactccagtctcccatagcgctcccaggcttattaggaagaggaaattcccacctaataaattttggtcagaccggttgatctcaaaacgctgcctcctgataagatgttatcaatgacaatggtgcccgaaacttcattagcaattttaatttcgcctccatcctgtggtcctgtgatctcgccctgcctccacttgccttgtgatattctattaccctgttaagtacttgatgtctgtcacccacacctatttgcacactccctccccttttgaaaatccctaataaaaacttgctggtttttgtggcttgtggggcatcatagatcctaccaatgtgtgatgtctccccccggacgcccagctttaaaatttctctcttttgtactctgtccttttatttctcaagccagtcgacacttaggaaaatagaaaagaacctacgtgattatcggggcaggtcccccgataagacagctcacgagatctcattagatatttcattgttatagtatggaaaggaagcatatttgtgtgctggtatacatgatgtgattttaaatcccaagtgataattttagaaaccaacagaacctaatattaaagctaaactactgtcctcttgaaatgatgagatgctattccggttgcccttttaaaaacactatcaagaggtaagttccctgtaagttccaccttcattttgtacacttaaagaatcagtcttttactggcctgggtcactgggttttctcttttggatgaggagggcttatttgacttcaccatcacatggcacaaaataaacgcattccacctacctggcatttctaggaccacctatttctttttttcttcaaatgattgtgacttcctgctccattcacctcaataactcacccacacgtcctttctatacttactaattactgtaatctttctcatctccatgtaacttttttttttttctgaagcattccaacatggatctctttgaaattctctatacaaaccacaaaaggccgtgacttcccacagtctttctgaatttctggccttagcaaaaacctgaaaaccccacagacatttatttaaccattttcccatgcaaacaataagaagtgggggaggaggatagcagacatctggcttactcaagagatgatgtgttagtctggacttagaatattcccagagaatattcctataatctgtattagcttctcatttgtgaatattctaacctcacagactctgacgcattaggacaaagccctttgcaagaaactgacttaatggaaagctcttaatgcaagaaagtttaggctcagggaatggactttatacactgagagatgtcaggaacacagggaagcactgggcaccttacgaacaaagtagatcgcacaactccatgtgccttcattctcaggaatctgctactaatagccttgtaatcattactgattgagagatggcaacctcagggccaaatgaggctcctgcattcataaaattctcagcttcataactgctgttctacaattttgaattctactgttcattttaggattttcccgggaaagggtagtggctgggctaacgtgtattgcagtgggcagaaaaccagcaagtgtttctccaattatttgctttcatagcttttctggaatttggacccagtgctgtggcttgaaagggtgaaacacatgcatgtatgtggcttgaaagggtgaaacacatgcatgtatgtgcacatgtgcacatgtgtgcatgtgtgtatttgtgtgtgttggggataagggaacatgccccagttaacgaatggagcagtgggccagatccacatcctgtgtaactcccacaggctcctgctacgatgaaagttcccttcacagggttgaacacagtgattccccaagggatcctggctgaagtgggtggaagttcagcgtttcttgtcccactgaatttttgaacatgacaaccacgtcctgctcctgatactgtgtgctttccttgattgatcatgtcaagatagccctgctaacattgtgttccaagcctggctcgattcttcttgatataactccaggaaccaaatcagccaaaggccttctttctctaattctaattctaattcaagggatttcccccaacccaacctctgtctccatcttcttagtatcaagctctgcccaaagttgatcattcctgaagaacaaggcatgcatttatagcataacaatgatttcctttagggactttcagtaatgcaccattcatttgggacagtgatgtgacaattctcaggcaaatgtggaagtagatgtctatgtcatttgtgaatatgtagaaataaagagttcatttacatcaactgtcccacctctgtcccatacctctccttccccatgaagaaaagagaggcagaagtagaatttaagtagaatttaaaattaaaaataaaaagaagatattttaaagggttaaaatattaaaagaaaactcctttgaacctcaataaagaaatggctgttgaatctcagcctcttttgccccatcttcctaatggctgggcccatttctgttgccacacagcccacatatcctaagtagccccacatctctatttttgtcttattctccttttgggatcagacttttatttgcaatgtagggttgctgtatccatagcacatggttaactctaatatggatgcaattttcataagtatttatattttttaatgaaatacatacacacgaaaaaaagcacacatgcagataattcacaaacaatcaaatccttgggaaagtctctgccatctgttcaacaaggtcaagtgtcattaggagcacagaacagccaaatgtaaaatttcttttcaggagctttccaagtggttggaataaacacaagttagaccatgcaaaattcttaatgtatattggtctgggaaagtaaagatggaaacagagaatacctagggagctatgcaacacaccaagggccattatccacagtaacaataacagtgacaacagcaataataatgtacaatgctataagattattaaaatctattctataatgcacagagaagtacctgcttgaagccattaaatatatgacagggtctgtcttcagtgcgatatatcaaatttggcaattgaaaggtatataaaatatatattttttgctttcaaaatatggaacgaactaaaatacaaggcttttctgataaactataaaaatttaatcagcacttggatctaatgacgtatctttataatacttcctctgcagatacattcacttagttcaaaccttaacatacaaagttagcctcaggagaatcatgtttccttccattcatttcttataaatattattatccacttgaagtcgttctgatgaaggaatttcctccctattttttcagccttttttttctcctcttagctaagaagacatcaggaagacactgcccaaagtattcattccccatgacttactttcagtttccatttttgagccattaaaaaaaaattctcaatgttgcactatctgagtgattatattagatcattaacatggaaatcttaaaacgtggcccttaatgttgtttgtctatatttgttcctattttcatctttctctttttcttctttttccctttcttcctgtttccctcccttctttccttcctttcttccttccttccttcttagaattcactgaagtatttcctaggttgtcttttacttactactttaatcaaagcttatctttgtgcccaatttgtaggaagtgaaaatgtctctttgaaattctatattacatagacagagaagttgggccttcgagggcttgagtttcacttaaatactatacacatgtggtatcacacaagggggagggggagggaacaaacataaacataacaattattttcagtctgtctttacaaaagaaagcctcttctctatgaaagtctttttgacatctgctcctggaaacctgccccaagaacacattctccattgctttgcaaggatctctttttaaaagcacatccatccactgtccccaggaggtcacgtatgttggattatcctgttcttagttgagcaacgaataagcactggatgagttttccagggataagctggttgcttctggggtggaaacattatatgttcctgaaaaacagagcagcaactcagccttgaagacaagccatcatgaactttggggtgtgaacatctcctaagggacccaggggagcagtggtctaggcactaggtaaactcggccatgcctggaaaccaacccatacctgccctcttcccaagagctagaaatgccagagaactaacagagttgtcgttctcatgcatgtgtggcagccaacaagcagtcactacttcacatcataccagcagccaggtttctacaaaggacgggaagatgtcaaggtgggaagccctccatatgccatcacgtgcatggtctgggaacatctgcatgagggaatctccctggtcctcttgggttgtggtgacttacagaagctcttgggaggcacctggaggctctactgaaagtggaggtttgtaaagagagtaaagggaaagaaaagagaaaattatagggagagaaaaggcaggaccagaaaagaagcaggagtcaggaacgtcaacagaactgctgagaatcagtgcagcaaggaaggcagcctctgagcaactgcacaggcttgtgtctgcggggaggtggggactgtgcacagggagtgcgtggagagtgtgtgtcgggcaagaaaagggttgaagtgcccaccctaccatcaaattgctgaaccgccaccaccgctaacaaagtttccgtcatggcctggggggatcttaggggctgctgacaacataaaccaaagttacggtacttatggggcccccaaacatgcccaattgggactttcataatcagaagtgaaggtcccccagtttcatgggtaattcatcaaattgaagcagaaaagaacccaagtcctctggagttttaacagttataggcattcacaaaatttgcttgtatatgaaaagccttaatgtggaacattgatacatttctcaactctgcatttgtgagatctgttgagtttcaaaaagctagaagaaatcctggggcttattttcctgtgggggagggatggtggcatgggacaggggtttcaatttgctagaatagctgagatctgttgcccaaagttattaattccattcatttcaaatctccaaggtagaaatttaactgtgaatatttctaatagaatagctaactagggtgatcccttatgtaatgcatgcacacttctatgtgcttccatgtgtaacacaagcacactttataaaaagaacacaaaaggaaaacaaacctaaatagtgagatcctgtagtaagattttctaactgtattctttgctgccccgtaaccctgaaacatcacctatctactcttatttgacataatttgagaagaactctgtgtttgacaaggccagcaatttacagttctcattttgatggatgatagtttgacagacagctctccaaatcattgtctagattctccaaatcttattctttatgagttattataagttcccaacaaaggcagctgccctctgtacccactttttggtgatttgtgaaaatgtaagttcctctatttaacctctaccccaaaagaggacattttaggtaaatgccatgattggggtgaaagagtaggggtgttgaggctccccatttgaccaaatgtgttctgggcaagcagggagaacatagaggccactactcacctgttttaccaaacaaactgttaaatctccttgatattggagaactcatagaaaacacaggtgtggatgaacccagggatgttgactagaagagagaaaaaaagggaaaatcacaaagcaaatttgtgggaccaaagctgtttacatccctagaaggattgattttccaccctctagtggtcactgccggcatctctagtcccactcccagaggtcacattaaaatactggaatcttgtcatctgtattagaaaaataactgtcaaatacaagttttattgtttgttaggcttctagtattttctgacatgtgaaaggcagtcagatatatccaagggcaatagttatgttccacaatgaactatagaaaattttatccattattattcttcaacttgttttctctaatgccttgaatccccccagaagactgcttctcattgaacatttgatttcaaccttcagtttatatcatatattattttaaaccctatttaaatatgtggagtagcatctcaatgacagctctatggctctgtttaataggcagaatgacttgagaagcaaaaacaatggaatgatctatgccaaatatagctgttgagggagatgggtttgaggatgcaatatatttagcctaattaatcaaaatcctgaagaaaaaatttagtactctgtacttcagaatgctagtggaatacatgaggttataaaacgaaaagtatctgcagagaaaaggtttacctttgagtgtggtgaagaccatctcgacaatgaaaacttattcagcaaagcttcctgtacctgcattgttaaaaagaagctatcgtaacttcaacatgccagaagcacttcacgcttttctagaaacatgaaactgtcattgctcttaccttcagatcctagaggcatccaaagagtaaactgaataatccctgagaaaaaaagattaaaaagaagtgcattttaattatagtctattgtccagcaaaagagaaagtactattaacctggtgttaaatttgtactacttctttttctatctgagtttatggaatgagtccagtacatgatactgttcaatgagaggcagttggtccacaccaagggactctaaatgttatgatgttaggaggatattttctattttcccattttcctttggttgagaactggaggtcctgttggttatgctatttatacacctcttgtgtctacaatattcctcacatagttgtgatgagaatcttggctatggggtgggataactagttccttccaaatgaggcatatcatgaaggtcattacatatgaactttataacttggagacacaggcccagtaacagaaattaaggttcatatgttcttggcacaagcatcctgaaagcagtatctcaagtgcacctccagcctctgcctcttcacaagctcacagtggcctcaatccttgggcaggttttttcctgtattatcacctctccattgggtgaaacagaattaatcacttccttccttgtggtttaaaggcttgctatctatacctctgttatatttcttctaacaaactggtctgcattgtaattagttacgtgctgcaggagagcaaagaagatgttttttgcattgtagtacaatcaagcagattgtctggcattcacaggacattcgttctttgatttttgatgtttccagagaagctgctatgtggtacataggatttatttcattcaaatgattattgagaacctactctgtaccaaggtctctatcaggcatagaggtatagtgatgaacaagaaaagggcaatccctgtcctcacaaagacaggattttcatttaggagataatagactgcatcaagataatcttagacaaatggggattttccttttactggtgtaatcagggtatttagcagagactgggaaatgacactaaattataatgtaggtgataaaaagcatgaggttccataggatcagaagaatgtgttctttccatctcattgaattctcattattactgctctttagagctgaggcttcctctgggctgaaatccttccccattcctactcttgtttgtgtttctatcattaatttgtcctacaggaataaaatcttcctgaaagtcccgcactgcaaaactcacctggaagacattgaggatggcaaatacgatatggaacacaaggaacactactgtctgctgtcactggttaatcactagatgccaagagcttactgaacaaaagcttggcaatcagaataaatggggaaggaaggaccttatgaattgtctacttagcctaagaaacggcaggtttagttcttctcttccaaaagatacaggtatatcactggaattgtacttaaaatttatagatgactagcaaatatatactttatatgtacttaacatttagatcaatcttatttaatacttggaggttagaagaagcatctttaggggaactatataatattctgttagcattttctctgcattttaaaaaatcatttcatctcaaacacttatcagcgtcatgaaatcagtaatgactcttaaacaattcaacataaaggtttgaactctgcactagatgtctctttaattttttaatatttaaaatttagttcaggcttttctcaccaggtgcctttagtggtgactaagataactgacttctcaattgtttctctgaaaaaagtgttgctgtgggaataattttaatgttcaatgtgatatcatggtggagttttgtcttttaaaacattagaagcattttaaatactaagaatcaaatatttatagatcaaacacttgtgttttaagtattatacgggacctgtttacatatagtaaatgtgtatgtatacatgagttgttgctgaagccgacaagcatattacatacatgcattttccctgtgccatcatagttgcagttagagttctagtacctgtaggctcgcctgggaggcagattagacccaaaggtagacatttttccctttccctgaagcatgatggtggtagttgattctttgatttccttagtaccaaactttaaggcttttgtaaaaacaaaacgaaaaaactaggagcttggaacatttaaaaattaacgctgctaccatcaattcatcaaatatttacttagaaccttcatacattaagattctggtaaccaataaattagaatttatttcttctgcataaagtaaattttcatacactcgacctactgagacagcaaaggtgtcctaatttgaggcatttgtgtaatgcctacataactaaatggtaactaaaatgggacagcatggggcaagaccttgtagttcttcacagactatttgtcatcagtttctccaattaatttgctgcatgagccaaataaccataattcaccttttgtacccactggagccataattagagaatcagagggtgtagacagaggttaatgccaatgacaaacacagggcaggatttattattattataaagatcattacatacaaaagattttttttttaaattcctaattctaacaaaggggatcaaccagaaatgaaactaagctactttctgaagtgacactgtgtcagaataatccagatttgaatataacattttgccacccactgacatttagatgaaggactgcctctccggaagagttcagaacatattcaggggtgaacctaacaccagggaagaaagactactgatgaaaatatttttccactttgaacaaatctgtaaactacacctttctttatagaaaaatgcttggaatagtcactgtaatatttagctgtggataaaaatttgtgaaaataaatacttttgaattagaaaaagcaaggaagaagaatggggttgataggatgtatatttaaaatagattaaccaggaacaactgcactgtgttttatatatgtgtgataacatatgtataattatatatcactatatataataactatatctttatatctggtgcaggtgagtaaataacccatgcaaatatctggggaaggaatagtccaggcactacaggaatatcaaaaaggccaatatgacacaagcagagtaatgacagagtgatatggagtgaggagcagatgaaataataagaaaagtaggcaggtcgttttgaggggtatgtgtctcaaattctaatttgcatataaatcaccaaggtttcacattaaaataaagattctgattcaggtggtctggagagtttatatttcttacaagtttcaggggatgctggtgctactggtctgtgtatcacactttgaataccaaaggactggagatgcgtgcatggtaaggagctttgggatgtgagtaatgtgggttgaattgtgtcttccccaaaaagatgttcaaatcccaactctcagtacttgtaaatatgacattacttggaaataaaatcttgcctagtcaatcaagttaagtggattcagatgggcccttatcaaatgactagtgtgcttgtaagaacgtggatatttagaaaaacacacagtggataaagtatgggaagatgaaggaagagaatggagtcatgtaactacaagccagagaatgccaaggattgatggcaactgtgagaagctaggaaaagacaaggaaggatcctcccctggagccttcagagaccctgagactgatgacaccttactttcaactcctagcctccagaactgtgagagaataaatttctgtacttttaacctactcagttggtggtaatttgttgcagtagcctgaggaaactaataccttgagtgggatggagagtgaagtcattggagggttttaagagaagaatggctcggtctgacttattcttaaagaatcaccctaattgcagaaacaagaatagactgaaggcaaggggctacagggaagtaggaagaccagttaggcggctatagcagtaaacctaactggagagtggagagatggtggtttgaatcaggggggtagtgatggtggtgagacaggaacagaatctgaagatgttttgaattactattgataaaatttgttaacattgtatgagctataaaaaaatgagggtggctgggaatggtggcttactcctgtaatcacagcacttagggaggctgagatgggtggactacctgaggtcaggagtttgagaccagcctggccaacatggtgaaaccctgtctctactaaaaatacaaacattagccgggcatgttggcgggtgcctgtaatcccagctcctcaggaagctgaggcaagggaatcacttgaacccaggaggtggtggttgcagtgagccaagatcatgccattgcactccaacctggatgacaagagtgaaactccatgtcaaaaaaaaacgtagaatgatttataatactttgggtagaaacctagtaacgggattgctgggtcaaatggtgtttctggttctagaaccttgagaaatcaccacactgcctttcacaacagttgaactaacttacactcccatcaacagtgtaaaagcattcctatttctccatatcctctccagtgtctattgtttcctgactttttagtggtcgccattctaactggcttgggatggtatctcactgtggttttgatttgcatttctctaatgaccagtgatgtgggagatcggtcagggtggtgggagaagctataaggaaagacgcaagccttcttgaaaggttggaaggtcttgcaaaagcttcatgagagaataaaggtgaaggaagaaaattctctttctctgaggctaagggtgagaagtaggtgcaaggaaaagtgaagaagtttatctaaatatgcttgtttacttatgtcatcaggaaactgacttttgaacttctgagcatgagactgctccctgtaagagggagcaaaaatgttaattacccagcaattgtgttgactccaggccttggacgttatgccagtactgaataaatacaagcagctctggcttatcgagactgctaactctcctctgcccctagggctcgcagcctcctagcctgctcttaccctgtatatttgtgtctgagtactcctttcttctgttgctcagccagggtctgcgggatggacccggcacagtgatgatgagctttttttcatgtttgttggccgcataaatttcttcttttgagaagtgtctgttcacaccctttgcccactttttgatggggttggcacaagcacatgtatgtttactgcagcactattcacaatagcaaagacttggaaccaacccaaatgcccatcaatgatagcagcctggataaagaaaatgtggcacatatataccatggaatattatgcagccataaaaaagaatgtgttcatgtcctttgcagggacatagatgaagctggaaaccacagtctcagcaaactaacacaggaacagaaaaccaaacactgcatattctcactcataagtgggagttgaacaataagaacacatggatacagggaggggaatattacacacaagggcctgtcagggagtcgggggtaagggagggatagcattagcagaaatacctaatgtagatgacaggttgataggtgcagcaaaccaccatggcacatgtatacctatgtaacaaacctgcatgttctgcacctgtatcacaaaacttaaagtataattaaagaaaaaaatagggctgccaagggtataaacagggtgtttcgtggcttaataactgtataactataaggatggagtctattacctcctgatatgaggaacatgatgagagaaggtgagaatggggaagatgctgggtaagtggggagaatagtaggagattaagagctctttttgaggtatgttcgctttgagatgcctattttgcctgcaagtggagatagtaattaggctacttggcataagtctggagtccagagcataggtctccactggagatttatctgacatgagttattaaaagaaattatgatgtttggcaagcatgtccttaagttgtgagattaacatcaagaaggacaatcatgtacttctaaaacatggtgttcagtgtcacttatttgaaaacatactgggccattatttgacctgtgacagttctgacattcattctaagactaccagatatgaaagtcaggagactgattagtttcttttttggtgcttttctcactctaaacttcaactttccatatcattaaagccactaaggtaaacaattagcctaagaggtatattcattacttttttgctgcctttaaatttgatgcctcattgtaaaaaatatgacctcacttgtatttgtgtggatgatattttaaaagatcatactgggcagagaatatggacactttcattatttaatactttagactaatgccaatcattcaaacatgaattcttcattcatctgtcttgtcaaagaaacagagctcatattgcatatgtgaaatatcacctagtgtctatttcaatcgtatatattttctgtttgtatcttagaaaaattatttcacctcaacaagcatattgcttgttggaattatctggatatagtgataaaataattattttcatcaacatctgaagaaaatgcctatgtatctgttgggatgggaggtgggatggagaggtgtgcagttgtctagcaccacttgtggctgggaaggtatgtgtgtctacagtaacagaaaaatctattgtcaccacaaagattccccatagctcctttaaaaataaacctgccatcttgatctccatctgcctgaatctttggtatctctcccttagttcaaaattctgacagagaatagaagcatatttatcaatccttcaagccccagtagaaacatcagagggagaaaacttaacctattttgaaatggttgaccaattctcagtgacaaagctacagttacagtctgattttcttgtccattgccaagaaaaaatgattcagtctgactccaatttataagggcatgttgaaagcaagaatcctacttgtagagattcttcttctaggcatgaggaatggtttttccaggtaatggattcctaatttgcccttctgtggaactagatttgcatgacagatgacagaatatttgtcaccttaagattcttgaaaaattaatttaaagccatgctatttctaattgttttggcttatgctctgaagtttttttttgttttgttttttgttttttgtttttttgagacagagtctcgctctgtcgcccaggctggattgcagtggcgcaatctcggctcactgcaagctctgcctcccagattcacgccattctcctgcctcggcctcccgagtagctgggactacaggcgcccgccactacacctggctaattttctgtatttttagtagagagggggtttcaccgtgtttgccaggatggtctcgatctcctgacctcgtgacccgctcgcctcggcctcccaaagtactgggattacaggtgtgagccaccgtgcccggccctgaagtttttctaaggctgccaaaattgtggtcaccaacataataggtaccatttttccattatctagtgtaaaatatatataatatgttatataatataaaacttaatatatctgctggtgcatatagctttattatcatataagctatatgaaagcagaaatatgcatttaaattcaacatttgcaaaatgtttccttttttttttttttttttttttcttgagacagagtctcgttctgtcgcccaggctggagtacagtggtgtgatctcggctcactgcaacctctgcctcccgggttcacgccactctcctgcctcagcctcctgagtagctgggactacaggcgcccgccgccacacccaactaatttttttgtatttttaatagagacggggttcaccatgttagccaggatggtcttgatctcctgacctcgtgatccgcccacctcagcctcccaaagtgctgggattataggcatgagccaccgtgcccggcctgcttttagctcttacaatcgagggtaaataagggtggattgcaatatgcatatatttgaagaaacctgatacacattgcttcattttttcatacagccttaagcagattattaaatttacctttttatttgagtactaacacttttcctacatagttagagagagctgtttgctcagttaatgcagcaaagggatgagggtaagaatgtgtgacagttagctcattctaatttgcttattgattgttggacatattccctcaattagttgacctcagctcctatattggggcttacattaggtgaacacccagggtctcagggctccacgtgggtgtttgaaatcacttgtctagatatataaaagagaacaggatatactcaccacttgcttggacacattttactgcctaaacggttcatttacactggccagtgatgcattacttcttgcccctaagtgtttctcaatctgtgttttgtatctaaaatacgcctttttctccataatcttttaagttgtctttttttgctagcattgcttataaaatctcattttctccaagaaatctctcttgaagcttagaaaaacaaaattggggtaatattttctaggtaagtaggcacaattctataattctatattccatgatttgtattaaatataatataaatattgatacatattctttgtctttcagaataggtatgttatgttcatatgtgtcaggttggatcagtatttaaattttactactgagataaacaaagagttattagcaatttttaaaagttgctgtacaatttgtcatatttcattgtgcttcttaatgacaaatatgtccaagattatattgggagctgccattttctgtactttatccccagatttgggagtgatacttattacagctttcagaatttcaagaaatagtagcactacttttaactagactaaagtcttttgtttttcttttgtataactttctggacatttgtaaattcataggatgtcttcctcaaatcacaaaatgcctatcgtctaattcaattgggaggtcagataccggtttaattctggagccatatgaatattgcctgagttaatgttatagctgaatatcatgcaaatgtggaaaaagtctattgaatcaatgtcattttatacatggaaataagcaaacagttgtaaataatatggaatattaaaaatctttctagtaaaccattgtttatgcttttcaattgtcttgctaaagaaacatagcttcttttaccatgatggaaaatattgtgctggaaataaagaaaataacaaattttgggtctcagcttaggttatcagttacctagtcttaaacaaatgatatatcaccagtgaaatttagcttttagacatcagtaaagtaagaaaataagccttgtttaccatgaaattttatgcaaaaattaggtaatatttaactggacttataaaggacttcttttttcaagaaacaataagaaaatgacctgaaatagtataagtttttattcataagtaaaattattgctaattcactttacaatagtctacttttattaatggtgatccttgcatattaagacttacaatcctattaataattgctcacctacaaaggacatttgtcaagggatcaaagtcttcatgtaccacataaaatattattataacaaagtaaaccagctgtatgcctttgatcactacatcaatatctagatcttttagcttctatttctgttccattctgctagccaagggtctttataaaaatacaaaggaaaatgaacagctagtaacacatttgatgtgccactctgatggacttcagaatgcttaatatcatcttgtttaatttcatgtttcaaaaagcttctcaatggcaggatcaattactttcaatctccacatcaatcagtccagatggttctcatgatttgctaaggatagctgcaaactgaactttgtgaacccacgatgcatattgtgttaatccttgatatggaaggatccttctgcagaataagcggagctgaaaaaggtgtgcttactttcacaaactgaatgttatttaaggaataaaaggtattctttaaagtgttaaatccagatgaacactgaaaaatacagtcttcagaaaaatcaagtgatttcacttctgtattcattgctgaaatgagaacatcatttcatttctaattctaatttgaattttgatttaaggttaaaaacactttaggattgtttcttattgcagaataatctgtaacttgttctgtaaacactagttgctaggctaaaacagtgagttatatttctttgtgtatgatactatttgtttattgtcaatttttcctgaactcaccagtagaatatattttaatttgaataatttaagaagcaatgtcaccaatatggatagaacaataatttcacttttgttactaatttaattaagaaggtgatttttagcaatatccatttctatttggttgtgtttttatctatttcaattattttctatattggaagtaattatgaattttaattttcatacagccctcttatcttttacttaaaaaatttaatgtttaatgaatttggagggagggccaaccttcattcttacatttatttatacattcaatgggaaagcagtactattctcctgaatgttcaaacaagcaatggaaatttgcaagagagaaataatttaaaattttcatcacattgtattgaaatttcatctttgtttccattttttcaccagatcttgagctcttgaagatgcattgcccatagatggtctcattaatttaagcaatgttttcagggcagttattctgtgaatatgcctgtaggatttaactggtctttgaattatggatattatttggaaagctggagaggagagtgaaggacactatataggtaggcaaacatcttgaaattttgaaacattgtgtaattattttacacataactgcctggacatgaccaacaggtataagaatagaatctgttggttgctaaaactatacatttttagttaatgtccaacatgtaccaatagatgccactgaagatcttctatgaagttcctcctaagagtcataactggtgaacacagttcatccatggggaatacagactataacttactaatggatttaggaaggaatctacctagcatttttgggaaaatgtgaataaatcaacctgatcaatgtggtgggctcctctagaaaatagaaaaatagggttaggctaagtaatgtggagatttgagaagatagatctggggtgatagaatattagatataacaaaggcagtctcttcaactttaccaagtttttattgtcatttgtgctggtgtctatcaaattgtatgtgactgcttgctttcaatatggcaaatgcatcttcagaaacattataactaagataacttttccaatagagtgcaaaatgtgcatctctagaaaggtttactcagagaactctggcaatacaatgccacatacatgcagcgttatgatctttagtttgatttctccttcccttgaccctgaataggactctacagtcaaggaagttgaatggagaaggaatttgagacgtcaggctgtgtttgttaaaagggttttatgatgtcttctctttgagtaaatatactggctattgtatctttcttccttccttccttccttcctttattgtatcttccttccttccctccttctttccctgtttcctccctccctccctcccttccagccttccttctttccttctttctttccttcctccctccctccctccctcccttccttccttccttccttccttctctctctccttccttaactcccttctttccttccatccagaattatttttgagaaacgctgtgatgtgtcagttggtagcacattctctggagctggttgcttggattaaaatcataacccttcctcctattagctatgtgaccttgaacaagctactaggccataaattaggactaataatggcatcaatatgatcttgctatagactgaattgtatgagttaatgtatgtgaagcatttttatatggtaagaattggataaaatacagttactattttatttattgaacacttagcattttttagctttttattttgaaaagatcttagatccatagggagtttcaaatacagagaggtctcgtgtactattctacacagtttatttcaagagttacatcttgtataatttagtacaatatcaggaccaggcattgacatttatacaatgtgaattcataggtctatgccaattttatcacgtattgattaatgtgaccattattacaattaagttacagaactcttccatcactaaaagtgtcttcctcacattttatagccatattcatctcacattcccataccatcactaacctctggaaatcactaatctgttttctatatgtatgttattttattaaagttatatacatgaaataatatgccatgtgtccttttgatatttgctttttttcactaagcataatgcccttcagatctatgcaagttattgcatgtgtcaaaagtatattcttttttatttctgggtagtatttaatcatatggatataccacagtttattcaaccattcacctgtccaacatcttggatgtttccagtttttctctgttagaattaaaggtgctatgaaagatattaaagatcgcatataggtttacatttctcttagataaatttccaggggtgcaattgctggatcttattataaatatatgtttagtttttaaagaaactgataaattatttccagagtattataacattttacaattcaaataatgtatgaatgatacagtttcttcatcattgccagcttttgttgtcactatttttatgtttagttgttttaataagtgtgtagttacctagtattttgataagagctgaggatacaaatttgagttgatcaagaagtcaaacaaatagaaagcaatcattaaagattacaataaaaataaacgaagtgaggagactgctagtaaccagggaaggaactttaattaaggtatttcagaaaacttcttagccgagatttcaaagaacaatgatctaattttacaaaaagccacagaaagcttattttagaaagaaagagaaacaagcacaaaattctagaggcagaaaaagggttggcatatacaaagactgtggaaataattaagaatgttttgggtgtgataagaaaagaagggaagtgtatgacgtggttggagaggtaggtagaaaacatcaagccaggatctatggtcattaaaaagaagttggaaatttttctttatattagcagaggaaagccaaacaaggagttaaagcagaaagtagggaatgaagagtcaagatcttgtgtgctttaaaaaaaaaagccactctgactactgtgaaaatagagcatttagggaggagatgacaagtggggaggcagatttgcaatgcattgtggtattctgacagagagatgggtgtggctttgagaagtgttcacggaagaaacggaaatcttggaaatggagagtcatggggaaaaaaagaacctaggtcgacctctaggttttgggcatgagtcatacaggcacagtgtagtaccatttattgagatgagaaaagctgttgaaggaattttgttttgctttgtttcagtgtgaacacgtgcagcagtcagcttgatttcagacatactaaatttgagttttctgttagatacgcaggagatttcaaataggagattggatatattagctaaaatattgcatctgcaagtctcttttttcaactgatcttagatggatggataaataagataaaccagttgaagtccagtggaaaaatattccattaaaataagacctatttgggcttctattatgatattttgccctttcttatctctgtgactagagtgaataataataatcagagatgcagttttctcacctgtgcaatagtaatttctattagatatgcatagtgtggaaaattagctaaactcattcatacaaagtaactctgacattgaaggttctaaaattaacaacatttagaattttaatcttccatctagttttaccatttggagtatataaggaaacctagaaagaaaccttatatccacttgtctatcctataatatttgcacattatagggtataatctcagggcataaatacaactttttataattcctatagagtgatactcttaggccaatattactgatcttgaaaagtggggtattgaggtattttacttggttgtaagccatcaacgtgttttacaaatgtgatattatgttttgatattagtaaaaaaaagaagcttcaaaatgtcctctctttctttgaatgcaatcacaatcatttcctttttgaattttaaatataagtaacctaaaacttaataacttgctcacaagtctagaagcagacaaaatatcacccacaaacctgatttataatactacgttaaactgacttaaggttttagacattcataaacatcttttaatctattccccttttgcatggatatgtaaatatatactccaggaggtataatttttgtagttattgtagtgcttttgtaatgaagaactaagtctattttcacagtgatagagaattgagttgagttcttttgaccctggatggatttgtctattttttaaggtgctacttaaaaatgtataggagaaaataaaaataaattatctctttcataagttaaaaatattttacatttcagcattctgaaagcacagaggtttcaacaaaaatgatggtttagaatcaaattcaataaagaaacatcagcttgagatcagactctctgaggaatgtttttttttcctgatgaatctcagccattcaaggtccttataaataagtgagagcacctttgatttttgactttttatagttaacaatttcagtttgctaatacaaaagacctcatgccttttcatccagaaaacagagaacactttctattatgtaagagtattatgtttgaaggagtatgtttgcttcaactatgcgtgctatggtacagaaagaaaaaccacctccctgtaggtctaaatccaaggggttttcaatgtatttgggttaagttatgttgtaaggttatagctctctaagatttttacaagatgcattattaaacatgaatcttctgtaacgtgtacagcatatcttgtataaaacaatgcaatattttcttctaagtatgggatggctttggtcacccatgcttaaaaaaactttgaagagacaattcatctttttcctatgaagcaatttttattaattgacataattcttcagcagtcaagctattacagtcattaggtagtcctttcctttattcagaagcccaagaagttagtagaggtttgtatactacgcacctttcaccagaaaataaaaagggagaactttaagtatttgacatcatcaaaaattaggtgttatggtgctatgcttaagttttgatattatatattaattacatttcccttagtactacctcctctgaattcttgagcttgtcagtagttgaaaacatttgaacctaaaccatttttgcacattcagaactaaatgtctgggtaacttgggaattaatactctacaacctgtgatggagcagggagcagggtcagctgtccattagcatctcttgtgaggtctctccattttcataaagaggcttgagaaaatctccagatttgcctgagggtagacacaaagcaatactcagttatactcaatgttatcaacctactggacttggtataaaagactttttgagcactgtattgcctattaaaaaacagtaaagtgtaaaagatagttctttagacaaattgggccacggaaatgccaaatcattagttttggtgtctgtaatgcctcacaaagttataaacttttatgaataatttgctaagaaattagctctaatgacaggtagtttatgtatataccttgataacatctacaggtatcttatgcacatgacattatagaaatatttgtttgggtttttctcaaccagtcattttctacaccataattccagctcagcccactccacttgcaattgcttgctctcatcttctaactcctgtttattcttctcaatttctgctgtaatggcttcatttaacctgctcctctgtatcttgtatgctttttagttcactgcttatttccttcttcctgctggaaaacttggctaaataactcgtattaatattttagcctcatttggctttaagattatctcataaggatatcctatataaatggtagttaatatttctgagcaccaacttcccttactccagctctcagacttcttcccattgttatgacaattgaaggctttttaaattcctgtcttaggaaaagtggcccaaaatttgccatagatctatgatgttttaattaatactgacctctgaatgatctagaaaataatggtaaaccatgtatacatatttgtgtgtgcacatgtgtgcatgtatccatagcatctgtgtgtgtgtacattttatagattttgtctttgtatgaagaaatatattgaatatccaaataagcataatttctctacaagtgaggtatgtgggttaaaatctagtgaacaaaatataactatacattcatgatttggaaaccttttaacatgattcctgaggaattactcaattgttaattgtttctgccttctctaccaaaatgactaatatttggactgagaagaaaaaaagagaacctcggtaaggaaaagtggaatttctgtaggtggtaactctggaatatcccaccaagagaatgaatcagattaaaataatgactgtagaaatttccttgttagtgaatattcagcctggccttaaggaaaatgtagctctctcttactgctttgtatcttatttcttttactatgtcaattctcaccttagtagaactactactagttctagtaccatggctatcatagatgcaaccattatattccatttagtttcttcctcaggttccctaacaattgtttgaaactgaatatatatgtttatgtatgtgtgtgtgttcactttcatgtatatggtgtatatgggatgtgtgcagttttcagttttatatatattcatatatatacatgcatatatgtgtataatatacatatatacatgcatacacatgtataatatacatatatacatgcatacacatgtataatatacatatatatacacatatatgcacacatataatcactgagttccaaagtgagtctttatttggtgcaattgtattctctcccctctgtctgctcactggcctttgcaagacatagcagttgcttgattttcctttggataagagtcttatcttcggcactcttgactctagccttaaatttagatttctattccagaatacctctcatatcaatcttaaaacctaagatgggtaaagaggtcataagatttttagtatgaaagagtttgcttagttaaattatatctcaggaaactcattcatctaccagttaaattgtaaaatattgtttgttgtatctgaaaaaatctttagaacaagaaatgtaactgggtagcctgttatatcaaagaaccctcgatttattaagtctcctcatagccatatccttatatagccctctctgacactgacttaatagacacttgacaaattatagtaaatttaggcttgccaaattaaaatggcagcaatgccaaatgagaacctgatctactctaccagagagactaagtggaggagaacccagctgatagcaccagtgaagtgccagatatttgagtgatgtcactttggactatgtaggccttgtcagtcatataaggaaacctaggcaagactccgactattatcctcctgagcccaaccaaagttaacaaattgtgagtttgtgttttaagcaactaagtttgatgactgctaattacacagcaatggataattgaaataacagctaaagcttaaagatgagataatgtgttgtgtttaaaaatttagcaagtgagtacttcatgaatatatttaccttgatggcattacaagctaaattttactgggctttattagaacaaattatttgagcattgatgagaaagtgaactttcaaactatcttatttacgtttatgtttcagttatcccacaaaagcaggaaattactttcaacaatgcacctgaggtattttatagtaactctctggttatttccatgtgtcaggtggagaaatatggatcagacacaaagacaataagattcattgctctctagcggaatactttttcttaaatgggtttattagtgaattgagaacttgatttgatgtttactctgacgtgtgatgtaaagttcttcctaaagccccctttcttttcctttttaaaattattaacatagatgaatacagagaatgtgaacatattagctatacagatatcacaacaggagaacagtaaatgttatgttttagactatttcaaccctaaaatatggacacaggttggaatgaggatccaattcagcataatagcctctaatggaatgggaaacatataaaatcctgtgttgctttatgaaatgttgcttatttgctgcatggttttaaaaagtatcagttttatttaatagtgggatctttatgtcagtgattactgatgtttccagcaagctaattcataccagggagacaatgtaaacatttagaaaggggattatatttctgtactatctgcatatgtcagatgacaacgagagtttcaaagtacaatcttatgaagggttgtattgcagatttggcctagaagcccaaaaccattaaatttttatcaaaattatacctgaaaattcttcatgttgtttattagcagtcattatctttacaaagatataggaaataaagtgatttccatctgttgcaatcacttgccttttacaatagacaaaattgttattttcattagattttacaaaaggaatgatatataaatttttaaaaggcatgtttaggttctttcaccagagaaatttagattattcttgcataaaatcaataaacataatccagcacataaacagatccaaagacaaaaaccacatgattatctcaatagatgcagaaaaggcctttgacaaaattcaacaacacttcatgctaaaaactctcaataaattaggtattgatgggacatatctcataataataagaggtatctatgacaaacccacagcaaatatcatactgaatggacaaaaactggaagcattccctgtgaaaactggcacaagactgggatgccctctctcaccactcatattcaacatagtgttggaagttctggccagggcaatcaggcaggagaagggaataaagggtattcaatcaggaaaagaggaagtcaaattgtccctgtttgcaggtgacataattgtacatctagaaaaccccattgtctcagcccaaaatctccttaagctgataagcaacttcagcaaagtctcaggatacaaaatcaacgtacaaaaatcacaagcattcttatacaccaataacagacaaacagagagccaaatcatgagggaactcccattcaaaattgcttcaaagagaataaaatacataggaatccaacatacaagggaggtgaaggacctcttcaaggagaactacaaaccattgctcaatgaaataaaagagtatacaaacaaatggaagaacattccatgctcatgggtaggaagaatcaatatcgtgaaaatggccatactgcccaaggtaatttatagattcaatgccatccccatcaagataccaatgactttcctcacagaaatggaaaaaaccactttaaagttcatatggaaccaaaaaagagcccgcatcaccaagtcgatcctaagccaaaagaacaaagccggaggcatcacgctacctgacttcaaactatactacaaggctacagtaaccaaaacagcatggtactggtaccaaaacagacatatagatcaatggaacagaagagagccctcagaaaaaatgccacatatctacaaccatctgatctttgacaaagctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagacaaaattgagaaatgggatctaattaaactaaagagcttctgaacagcaaaagaaactaccatcagaatgaacaggcaacctatagaatgggagaaaattttcacaacctactcatctgacaaagggctaatatccagaatctacaaagaactcaaacaaagtgacaagaaaaaaacaaacaaccccatcaaaaagtgggtgaaggatatgaacagacacttctcaaaagaagacatttatgcagccaaaaaacccatgaaaaaatgctcatcaccactggccatcagagaaatgcaaatcaaaaccacaatgagataccatctcacaccagttagaatgatgatcgttaaaaagtcaggaaacaacaggtgctggagaggatgtggagaaataggaacacttttacactgttggtgggactgtaaactagctcaaccattgtggaagtcagtgtggcaattcctcagggatctagaactagaaataccatttgacccagccatcccattactgggtatatacccaaaggattataaatcatgctgctataaagacacatacacacgtatgtttattgtggcactattcacaatagcaaagacttggaaccaacccaaatgtccaacaatgatagagtggattaagaaaatgtggcacatatacaccatggaatactatgcagccataaaaaatgatgagttcatgtcctttgtagggacatggatgaagctggaaaccatcattcttagcaaactatcacaaggacaaaaaaccaaacactgcatgttctcacttataggtgggaattgaacaataacacatggacacaggaaggggaacatcacacaccagggacggttgtggggtggggggagtggggagggataacattaggagatatacctaatggtaaatgacgagttaatgggtgcagcacaccaacatggcacatgtatacatatgtaacaaacctgcacgttgtgcacatgtaccctaaaacttaaagtataatagtaataaataaaataaaacaaaagaactagtttgttgagttcatttaggaactaagttgtaagaaatattgcaccagacaatttgttttctgagatgaagctcaagtaactatgagcacagtatcaggaatgacattcatttgttcccagctgtctctaggcattttgcactcttgaaaaatactaagttccctggacctgaagagattcatgaatcagtaagaatgtgagccccttgagtgttcaatatcccttcaaaccttagaaactgtaagtcaatgacggtgcttatcatatcacaagagtatagttagcttcttttaaaagacataaaagacccctctgagttagccctagacacatattactccaactgcctgaagaaaggtttagcgatccatacagaattactctcaattagatttagagaaaacattctctctttgaagaacactagaattgaggaaaatatggtagagcatataggttattttgcctttgttactttgtagaccttaaatcatggagtgagttagaacacagtatatttgtgacaaccatgacagttcagagaaatgcagtgaggtcatttactctgaaactgaaagacactaatctctgctctgagacccacaaagtcagattatctgttttacctgtgtgatttctattcctctcattttgttgttctttttataaaacatctttgctaaataataaagttattactctaaggtagtgtccaggtctctttgataataatgaaatgtccatggccaaatcccattgctttgttttgacagtgtgctccaagaaaattactttgatatgccctctcatattagaataaacacattctacatacctattgcctacatcaagttttgaattataccattttcaggtttaacctggtcatacagcagattttcttaatggttggtgaacacggaataatagtttaatcattcagataaactattttgcagaaacatttaaaatcagaaattgcagaactactatctgaactttaaagggacactcttaaccatattttgttttatttagtactcacgctgacaagttgatttaccacctcattttcccaacaagtgtcaagatttcaatatgcagttaatggtttctaaaaacagtgactatttaattacatccttatagtttccccaaattgcttatagtttgcccgcatttagttaggtctataatatttctcaattagtgtaaaaatttctactcctttttaatcattgatgcatataatgatgtataaaaattattatgtagatagcccctccatgaaaacttaaagtcaaaagcttttagcatcaaagtatcagaatacaaactaaagaaaacacaccaattcagaaagattttctttaaatatattaaagtgaataaaatgttcacagagaatcactcacatctaaggatatagactttttcctaaagtgaaactatttttggctcactcagactctgagtagtgtttcactgattttgaatttcactggtcagaaccagtgttggtagtaagaattattttcccagaagagaatggaaatgcttgccaactctactttcaacccttgctggaatccctatattgtgggtagagatatgactaaattaagcagttttaagtctaagccagaaagatttaattattgatttattggttttacaattgttaaatattgcctttaaccgagtatatgttttatcatgtaataatcactttggcagcctcaaatgtcatgggttcacagggtaaatgttaaggtaatagctaaacaattgagcgtataggagatctatagtaagtgaaaaaaattcaagatgtaatacagagtccagtatgacagacttgagaaactttcaaaaactaggaaaagaaaaccaaaagtcattcttgcagtgtctctgattgcactgacttgatgcagaattggtgcattaacatatgtatacattacatatgtatacatgtgccatgctggtgtgctgcacccattaactcgacatttagccttaggctaaatgctatccctccccgctctccccaccccacaacagcccccagagtgtgatgttccccttcctgtgttcatgtgttctcattgttcaattcccacctataagtgagaacatgcggtgtttggttttttgtccttgtgatagtttgctaagaatgatggtttccagcgatagttgactgagaatgatgaattaaaataaaaatgcatgcactttcaaatgtacttagtgcaacatattgaacttacattccagttttcctggaattacttgtgtcttgagctaaaggctgtatttggtataacagggaaggaaagaaattatttttcctataaaattagtttaaaaacacatataattaaacaaaataaaaatattatcccaccttttaaagaacatttactaagtcacagatattacctgaagtttagaaaatcacctaagaacaattgtttaaaaattatttagggaaaatgaagcaaaattgtttttacaatctgagattttaacagccagtgcactcctgttcttcagctgaatgtccccttcattctgaatgtctgcagtagaattgaattggggagcagttaggttccaggaacatattcactcctgttttgttctctccccaatctctgcctttcggtgactgtttgggcaaagcctcccttgtggtagaagatgcctcacttctggggagaggagactcctcatcttgcagacaagaagcagcacccactggttcctgctccaaaagccattaacattataaactggccaggtgcggtggctcaaacctgtaatcccagcaccacttgggaggttgaggcagaaggattgcttgagcccaggagtttgagaacagccttggcaacaaagtgagacccaatctctacaaaaactagagaaaaaatagctgggtgtggtggcactcacctatactaaggaggctgggctgggaggatctcttgagcccaggtggttgaggcttcagtgagccaagatcatgcctctgcacttgagcttgggtgacagagtaagatcctatctcaaaaaataaattataaactgattcacaataactttggttttgtcactaatatgctgaatattttcgttacaactaatatacaaaatgcaaactggctatcactaccattctgataatggaattagctgtcctacatacctgatgacctaatgcttaacctaatcttcctctttcccactttgatttggaaacttgttacaatagagttctttacctcaaagtcttaaggaattcaagacaagactagagtatgttaagataccacaaaaaaaaaaaatatatatatatatatagcaagagctttcttgagtaagcaaattttatacatataaaaataatttacatgcaaatgaccaagaggaaaggttaagtgactctggtgtaaataattagtttactgattctgccagagcatattaagaaaaattcactttggaaaaataatatggatttaaagaagtaacaagtgggtttctctaaagcacagtttggctttttactagaatatcaagtcacctttttgggtgaggagagtacaatgggagtgggcagctggtgcaaataaacatttacaattacttaaaacttcaacaaatgggatctgtatttaaatctgttttggtctgtcttccctttgttttttctaatccattccaacaatgcaaacctcagccactgtcaagggcaatctcagactggaggttgctgcctagggtgaggttctagcaagactgacaagcagagctcagggaatagtctgcatgggaaaacagagccagacttagaaggcattgctgatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcacagtctgagatggctacattcattatggacaaacagtcaaacttgtgtgctcagttactggcatggcactcccaagattgataattaggaaagttgataagcagaccacattattggatgcagatgatcctgtgtcacaactccataaatgtgcatttgaccttgaggatacagaaagaaagtacttatgcctttctcaagaaagaataattcaatttcaggccactccatgcccaacagaaccaaataaagagatgataaatgatggtgcttcctgggcaatcattagcacacataaggcgaagtatacattttatgagagaatgggccctgtccttgccctggtcatgcctatgcctgtcgtagagagccttaagttgaatggcggtggggacgaagcaatgcttgaacttacaggacagaatttcactccaaatttacaagtgtggtttggggatgtagaagctgaagctatgtacaggtgtggagagagtatgctccgtgttgtcccagacgtttctgcattctgagaaggttggagatagttccagcaaccagtccaggtttcagtaactttggtccgaaatgatggaatcatatattccaccagccttacctttacctacacaccagaagcagggccgcggccacattgcagtgtagcaggcgcaatccttcaagccagttcaagccacgtgccccctaatgaattaaacacaaacagcgatggaagttacacaaatgccagcacaaattcaaccagtgtcacatcatctacaccaacagtggtatcctaactaccatctttttgctaagacttaaacggacttgagtgcagcaaaaagttgacaaaaaaggaaaaaaaaatgaacagtcttttgtggtttattgggaaaacttttcataccaggtgatactattctaaaaccccactatctatctgcaagtgccgatttgaaatgcagaagccacagtaaaacaaaaaaaaacatcaaaatgtacaaactactggaaattaattttttcagctgttttgttggttggttggttggtttttgtttggttttgtttaagtgggcaagaagtaaataatgtggctggaatacaagttgaacaaactagaagacataaatctaacatagtttttatggaccacgtaacttgtatattgtataagctttagtaaaaggtacattttcacatattcaccatatccttttttatatcatggtattatagtacatcttgtcaccaaagaggttgttctcttccccactcacctttgagcttttgctttaaaatacattcaggttccaagcctggccatgcttgtttaatttaattatcatgttcttcccagtttttttttggtctgaggctagagctttttttttttccagctgaagtcttatgacttttcgtgagtcaaaattgtttggatttcagcaagtcaaatcttgtgatggcctacatttttttttaagattatgtgaagtctgtgcaaaagctttaaaaagctgcctctgccttgcctgcaacacatgcaatgtatgttaacttagtctctcttctcagacactgttggtagttatttctgcattttccttttttttaaaaaaagtatttatagtggttatccaagaggttctaacattcacatgcaatttggtgtggccattttgccataaatgagttaatagtgcagaacatgttgatatttgaagtgttctctctccttttcccatagcgtaaatacattatgtgtgttccaggatttgttcaggtttttccccgctcctgatcttgtacataacttgtattacgtataagttaaacatttaattttgaacttggaatgttcccagtgatttcatccagcagagtattttctgccttgttggcaagtgacaaaaatatcatgagaagcaactgctgccagttgggagatggtgcccttatggtagaatgaggacgatctcagcaaaagcatgttttattaactttactttttgggggtgttggagggggtagcctaggccagaacatcattgtaatcttaaaacataagatgcttttattagatgatcaactaaaatagctggaagacagtactttagaaacagatagttgtaagattatgaaatgcaaatgtaacttgtgtttttatttttcttttccctgccttttttgttttctcttctccagtactgagcatctccacaaatgtctcctaactcagaaaatgtttcttttcctttcacctgagatttggttgcattcagggttgtacgttggccttgcatgcgaaacttggcagttgtaccttgctttcattcctgaacttcggttatgcttttgttcggattcttcgaaattgcagcagactctttgggctacatttagtacaagaaccacgtgcataatattatacggcacagtctagtaatacaatcatccttcttagagtaaaaactacctctagattgtggtaagcttttactgtctcataaaacaggagccacggtactttatgaatgcaaaactgtaacttcctacagtgtttccatacagaacattgtctttctggtttcctgggctattttggaaaagttttcattaatagacttttcagaaattattattagtaacatttttttccagctttgctgttttcatcactcattctttgctcagactccagcattcagtaccgtgttggtccagatgtaggtttatatgctcatttttagcttatttcttgtaccttgcagcacactctacgcactcagcccttaaggggtttactttacaaactgtgtgcctgtaagatgtattagcaataagatagaaaattgagcaagtttataccataattttgtagaaaaaaagaatctgctcaattccatatttcatccatgaaaaacttgcaatacgagcagtttcaaggaataagaagaaaaaaaaaaagagtttataggtcggccaggtctgatggctcacgctcgtaatcccagcactttgggaggccgaggccagcggatcacttgaggtcagttcaagaccagcctggctgacatggtggaacccctgtctctactaaaaacaaaaacaaaaacagaaacaaaaattagccaggtgtggtggtgtgtgcctgtagtcctagctactcgagagcctgaggcatgagaattgcttgaacctgggaggtggaggttgcagtaagccgaacttgtgccactgtactccagcctgggtgacagagtgacactcggtctcaaaaaaaaaaaaaaaattttatgggtcatttgtggtttatttatttctgcaaaatgtccattcccatctttagcccacttttaattgggtgattttttttagtaagaaaaactttatatattaaacattgatttttaaattatttactatatccaatcaacagctttctttaagaactctctaatgcaaaatagaagagtggtagaagctgagtacaaaaaggaaaaaattctaattaattaaatgtatctttgattaacagaaaactaatataagctacaataatattgttatttcagaattccccagttacaaagtaacagtaagaagatggtgatctacaaaactttacttgtgacataattctagtgtagtttatttaagaaatataaaagaaaatgattggattacaaaaaagattaatataatgatacatcagtattatgagtatctttcttaaataaataatattttctgaagacatggataataaaaaaggtagcacaataaaattatacagggacaacttattaaaataaataaacatgctcagttcattgtaatgaaataaaatttgttttctgaaaacaaatggaaagaaaataataaccatgttagcccagagaaaggaatacacttgaattatagatgaacaagggcatatactgtgtatgactatcatgtaaccatgaagaataggtcaagataagggaaaagcagcagaaacatcagttctcaggcagtggtgcctgagattattacagtgtgcccaattagtttatgtcacttttaaaaagtcatttaaataaatgtatttgtggaagaaaaaatatctgaacatcaggtatggtctgatccacaatgatccaacgatctgtcataactcattctaggagtattcttatacagtttgcaagagaaattacatgtggagctacagaggaacatttatcaaaattcataaagctatttaacctgaatgttacatagtacatagtgaccatcatacaatagtaaaaatacaatatctgatactatttttacaagctatgacgtaaacaatttaggctctttttaaaaaaataaaagaaatttgattacaactttatttcaagcattttcagttagacataggtttatatattttcactcaaaatggcaaaggaccttctgtaggtaaaatatattctgtgtttaaatgcttgcattctgaagtatgatttgccatgtacaagttcaggtaggacaatgaagctgctgtagcaaaatcctggctgatgatgaagactcggacacttttcatctttcatgcagccattcaatattttgtgtatttacatgaaggagaaaagaggggaggatacaaagagagccagtattctttttggatgaagcagcctaattccagagaatgagctttccattttgaactcaaagactgtggtccccaaattgaattcttaccagtccaaggagctgcctttggcctgtgaggcaacacttgatgatgaagtgagctaggaaagtgttaactgaactacagagatggctgcgtgcaaaacaagtttccaaacatgctcaggcccacgcagaggtgaggtgcagccagaactattagttaaaaataaatgccctcacggatgcagacatagagcttgtaggaagagtcaccgttctgggggcctgattgtagtttccaatacctgccttcaccactctctgactcttctatttttctgctttgtttaatttgagtccaaggatttcattagcaactttctgaaaatacaggaagacagtctcctgttttggctgagataaagtggctactaaaaccattttcctggcaaaaccataagtgtttttcaggttttactgtttccatgtgctccaaataaattttattgctcaccaaggcaaccagtagcaaagcttctgactcttcgctccctttcttcggtacaatgtacacatctttttttttttttttttttgagatggagtctcgctgtcgcccaggctggagtgcagtggcgcgatctcggcccactgcaagctccgcctcccggggttcacaccattctcctgtctcagcctcccgagtagctgggactacaggccccggccaccacgcccggctaatttttttttttgtatttttagtagagacagggtttcaccgtgttcgccagaatggtctcgatctcctgacctcgtgatccgcccgcctcggcctaccaaagtgctgggatgacagacatgagccaccgcgcctggccgtaccaatcttttaaattctccaagctttgctaatttgtaacaagaggattctctgtggtccatagataaatgcatccaccttcttgccgcgtattgtacgcaccccctacatcccatacttgaagagtaacattcaagtttcctggcaatgttatcccgctcaaaaaatatgtatatatattcatcactatagtttagttttattggttcccaaaagtttcttgagcaaaactcataggtcttccaggaggtgctgcttcaagcatgacaaatttcagttgccattcttggtttctttcttggggtctgatggagttcagtgtggtgctcaggctagctccccaggcagagggagaaggaaaggagagcgcctccgtaggtggggagagaaggaagggagcaggaccctgccctgggatctgggtgccctggagagatcaggggaaactagttgatgatacttttgttaaatgaaccagtactttcacatgcttttaagtaaaaatgaaatttaactggaaggacccaaatcaaacatggtatctcttgagttatctctcactatggatgacaaaggctgttgtcaaagttgatttcactcaattaacttgatggatattaaacaacctgtataagcccagaaaatgagggttctgggagatctgttattacagaaatgcagaggtgtcctaactcgtgttatgtgaaggtggccatgatgcagataaggacatggctatgaatgtgcaggctatagtttgccctgacctgggtccatgaccgtgccttgagggtggaagaaacaccagagcgccctcagataagatggctggagggcatgacaaaaaccatgaaagtaagaccagaccgtgcatgcaagatgaatgctggcatctggctgaatagaggaatttgaacaaacaaaatcctttttctgcaagctcttcacataattctactccacctggagcttcatggctgaaatgagtggttatctatattcaggtctagtcagacgtgctgattaattatagttgatcagcatacatatatcatgctttcttacatatttaatctatcccatgtatacataagattttgaaggataaattatttattagcattaaagtgtaaaatttgcttgataactataaaatgccttaaatacactagtatgagtttcgaaattataccaaaatgaccaatgtgaagggtagtgttactacactgggtatgtcctgccactacgtcctttaggagatttctatagcatcacaatgaagtccacctgtgtgtgagagagaggcttgcgctcgccttccttaccagcaatgcaaaagtgctcaggggacccagcttggtctgagtacgaaaacaaacctaagaggcttcaaagccagctctcctgtagtatgtgctcacatccctgaaagaaaagcaagaaaattccaaactccagattttctaatataagctctagtgaaatacttacctttcttgagtcaaagcagaagcaactgctaactagaaatgtcagcctgctgcctcagagaatttctatggctgttctggggtgaagagggtggagtctttggctttcttaccacaggtgatcaggtaagaaggaaccacagcatcctctatgaagaaatgctgtccgaggtgatacctggaatccaaagcttttctaaaggagacctgggaggggactccacacccatcaaccaatagcagcccagcccaaaggctgcaaatttgcttctttctgacacccagtggagaaacaatcaccagctcttttccagcgagtccagcactgtctgcaattggatttgctttagttgcaaggattgtaagctagttggtgtgtgtgtgtgtgtgtgtgtgtgtgtatgtgtgtgtgtaggtgaagtttgagacacctggtgttagtgtttctatccagttgtactaaaattggcatgaaatttcttatctagaatttcaagcctccagctgtgagccttattcagctatcattgatttcatcaccaaaaaagataaaaccaggaaatagaatgcgtgtgagagagtccaaatgattgtttcttttacccttaactaactccctttccttagcccctctcctgcacctactggttttctaaggtttattcccgcagtctttagtaaactaattttaaatgtgcgaatggggtgaccaggttagagactcccagggaagaaccatgctatgtatcccactaataagttctccttatggagctaaagtctttcactggagctgtttccagtgtaacttgatgtagcatttgggatagtctcatcgtggagcaccaccactatcccagttggccgatacctgtttcttctaagaggagaatcaggtaagttttcccaaagcgccttagggaaatcgtgccattcagagagctgcgttgtgctcatgcatctggaaggtcttgctgttcatgcactgactcttctaactccatatcctccattcctgggtgtttgccagcaggatggaatgatggctcactgaaaactgaagaagacatggaagacaaaaagggagatgagaaagtcctgcccattaatgataggaagatgggcacaatgcggtgacctcacaggtctccctgtctcagctcagctctgatgaagagactcatgtcatacagtctcttcagatgatcacagagaaaaacgtggtgacagagaggcagatgttttactgtttccacttctggaacttgttgcagggtatgaagagggtcagcaccagagaagatacagaatatcatgtctgcaatggatgaagccatcaaaggatggcttcacttcaccaccaggcagcactgaccaacttatggcaataaatcccgcagaccagaattgcacccatcaaatgcctcactcaccatatgtcagcccagaagactcttgcagtggtgagccagtctctttatccaccaagcctgacccagcaggcaggagaggcccagtaccaagatgatcatccacaataacctgcacactgcattgaggatggaggccagccctaacagcccgcagccctcaggagggagaggcagtaaagggctccttctctctttgtcctgatgaatgggcattgcactagaaagatgaacattaggagcagattatcagagcctcggtccagccaccatctcctctatgatgacccagatgggcaaaccttctgaaggcaaaggtccaaccaacatcctgggtggctggcattttctgaatttctatagctcatcacaaagtgcagcaggaatgggagtatttggtgcactttgattttgcagttgcctctgatggccaagagtcttagggccaaagatttctcctgacccaaggtccaggtcatatttctgcagcacagctgtgaccctcatcccaactacagccactggcacaatctccagtaatatttgcaaatgattatactcacatcaggttataaaagcttgttgtttttaatttgagttatatttttaaaatacaaaaatgtcttgttttttatgtttgtgttcatgtggtacattttccaggataagatgggctgtgcggtaatggcaaataaaccctccaaatctcagtggctggcctcctctaagtttatttcttgctcacggggtctgccgtgagaccagagtctctccagagcaactccccttccacccctgcccaggaaatagaacatgtgcgtaactgagagacaaatcatgtagaaaaacaaggtgattttcctagagaaggactgaagtgctttgctagtattagtcactatgataaaaagtagagaagaactattctatttctttaaccatctaagagacagaccattcacttggagtgaaatatttaaactatttcttcatctcttgaattaaaagaccttaataatatgaattcataactcgaatatagataataaacccagcacagtttggcacaacaatttgtatttcctcttgaaataccaaggctattttctcatgtaaattatatacgtatctatatacatattttcaaggactgaaattaattttaacatctttaaaacaccaaatagtatcacattacctgtaaaatggctggttacctcaaaggcagcattttaacatccttagctgctttaaaagattatcagcagtctatagcaaatattacatgagacatttaaagaatggtgcttcatttcatcatttaaaaatcttagtcaagaagagacaagaacaatttcttagaatcaaagctccttcattgggaaatcattcatcttggaaaaagcagaaatattttggctaataaaaaacattttattactaaattaacattgaagaagttgtaaaaatctcattttgctttaatttgttaaagtcaaagccttatatgcacctttgatttttataaaattttaactctttgaaaataaaatattaagcatcaaaagtaaatagaaaaaattaaaaataaaatgaaaaccaatgaaatggaacacagaccaataataaaatctgtgctgccaaaagctgatgctttgaaaagattattaaaaactgcaaaacacctagcaaaaggaaaacatcaccaatatcaagaatataaaatgggacattattatagaccctagagatactacaaggattataataatatgtatgctgaacaacttgaaggcaagaaatttgacaatttaaatgaaaagcatgcatttcaatttcttatggtatagttacttgcaactctggagagcccacataattcatatagtagccatcttctagctttgtgggttctctgtaaaaaagaaactggaagagtcacagtaaacgaacgacatatactttccacccttacatgagtagagaataatctgctagagcaaatgggctgggtgtgggggctcacacctgtattcccagcactttgggagtccgaggtgggtggatcacctgaggtcaggagttcgagatcagcctgttcaatatggtgaacccccatctctacgaaaaatacaaaaattagcctggcgtggtggcaggcacctgtaatcccagctactcgggaggctgaggcaggagaattgcttgaacccaggaggcagaagttgcagtgagccgagatggacccattgcaatccagcctggaaaacaagagggaaactctgtttcaaaagaaagaaaagaaaagagaaaagaaaacaaaaagaatctccaaatgctcaaataaactctatataatttaaatgtgttttaatttttctcttactgttaggaaattgatattttaagagaaaacaactagtcagtgattgtttccaggagaactccattttgtggaagctcctctgagacctaaaccctttaggggagctcctgggagagcctgagcttctcctgattcaggtcccctttgtgtgttcactaagagtctgctctttgccgagttttgtaacaaggttgttgaaaatggaagagtattttcagccgtgagcttactttgcaacattcagctttctttagagtttcaggaagttcgtaattgtcttataatgaacaagaactttcctataagaagaactacaaagcatgccattcagaaaataggtaatagaccttaatcccaggaatactaaatattttaggaagtctctaggttcagaaaaacccaggggccctgtggactgaatgccaacctcccctccctcccccctgcccccccgacccccaacccctctcacctccacagtgagctccctgctttcaggctcaaccttctaaagttctctttcctggctggatgagtctcccatgaagccccttccatctctccactgctcagagctctccagaactcacattgtgatttaaatccagggtttacttactagtctttacttactagtcaaagccccacatgcttgccctgaaatccctctagttatttagtgttagaaactcaccactaggaccattattttgctgttagatctatttttgggggaaatgcctaatgtcaggatttttttttttttgaaagagtctcgctcagtcaccaggctggagtgcagtggcgcgatctcggctcactgcaaccttcacctcccgggttcaagtgattctcctgcctcagcctcccgagtagctaggactacaggcacgtgccactatgcccaactaattattgtatttttagtagagacggggtttcaccatgttggccaggatggtctcgatttcttgacctcgtgatccgcccacttcagcctcccaaagtgctgggattataggcgtgagccactgtgccagaacaatgtcaggattttttggcttatctttactgacctggtctaatccccacagatgaatatttattgatttatttttttctctttttggaggaaggaagccctgttgtcagcatcctaaaagctagaaatgagaaaagctgggaatctcaattttcagtgtgtgctttgttttcaatattgtaccctttcctcaattggtctcagtggtctccagtccagagactctctgttttatcctctacggaaaatgaacattttgtcctttatacagaaatggacatgtggggccgtcttcaaccactcctaaaacactaaaacagacattcaataaatcctgtttccagccccacttaatcctccaagttacataactgcagattgcagcgctcacatagggaaccctgtgagcagcctcctttgaagctggtcatccctccagccttattcccccacactctcaacggtattgtaactaaggacctcagtttttaaaatatacttcagtcatccactctctttatcttccttcctgccgctctcacaccttgattaaaaccattttttccttccacccatccatgtctcttgactctggcttttaggtggcaagctgctggacttaggaccagatacagtatcgtatgtcatgagcctttggggagctcttcagtttacaacttggtggctcaaagatttcctttctactgctttagacagctttttggggggatgtgttttccgaaatcagctgctctttccgtatagaaccatacattgagattacatgagtggctgtgatgtctaatgtaacagaacatttgattctctttgtctatattgtttatagaaaaacatctcttctcattgatatgtttctttccccttccatctctgttactgtactaaccattaccagatctttaacaataaatttaggattttaaaatatatttgtggcaggaattactgtctgcctctagaggtaacatttgagtgaactgtcttattgtcattggcaacttccttcagatcatgccactgcattacagactggtcgacaagagtaagactgtctcaagaaaaaaattaaaaagattaaaaaaaaaaaagaaacctttctgaggtaataattggagacactggcaaagacatgtgacagagttttcactttcttttattacaaggtcaaagtatagaaatacctaaatattgaaccatggagagatgattgaattgtacaatattcctatgtatggctgattgattcagttagaactttactcacatattgaacttcaaaattttcactcccccgaccaatgctttttagccttctattttactttgcttcttaacactcatcactgtctaatatactatatttttcttgtttatggtctgcctttcccagaatagaatcttcatgaaggcagagatttttgtttttatttcgttcattcatctagctccagtaattagaaaactatactgcacatggtaacaactcgctaaatatatgttgaatgagtcatcaatgcttttctcttaacttaatgacatgggaaaatgtccataaagtatacaataaaatatgcagactcagaacataaaaaatatacacacactctcacacacacacacacacgacaaaatcttgacttcagggtgttctgctgaacttcagttgttcttgacttccacatgtggaggtggagcatctttgttaagtttataagtaatatgtttttttttgtttatgaaatgcctggttatatgtttcctttgtccagttttgtattcgtttctcttctgatttgtataaattcttcatattccataaacactactcctttttcataggtgttgcaaatcatcttctttccactaatggcttctattccctttttataaagtcttttgataaactaaaatgttaatattattgttgtaaaatgaaccaatgttttacttcatagttttgtgttttgggtatgaaatccttgtccactggaaggtataaactacttcttcatattttttgaattttaaagttttttattttttattttaactcattagaaattacgtttgtttttttgtgtccagtgacaggtaggggtccaattttatattttttctcatctgtaactaatgtcccagtaccattaatatttagagttgcccattctttcccaatggacctgaagcagaagatctcatgcactgggttcccttataattcggctatttctacattttgagctgtttgtctttcttatataactctgtagtcatgtaagtagtcttatgtatggagtctcccttctgatggagttacctaccccactgatttttttttaggctttctctttactaataaatgtatttacaaatacaaaccaccttctaaagaatgctttagttgcaccaaacatatacaagctttgatatgtagtgtttttattgccattctgttctaaacataacttcattttcttatttcaaatgtatttttaaatttcgcaaagtatagtatcttgcgatcttctggttaacaaaatctatgttgtcaaattgtggtctaagaatatgatcatattaattattattattactattttttttttgagatggagtctcactctattgccaggctggagtgcaatggtgccatctcagctcactgcaacctctgcctcctgggttcaagcaattctcctgcctcagcctcccgagtagctgggattacaggcacgtgtcaccacacccagctaatttttgtatttttagtagagacagggtttcaccatgttggccaggatggtctcgatttcctgacctcgtgttctgaccacctagccctcccaaagttctgggattacaggcgtgagccactgcacctggcccgatgattattatttattgatacttgctgtggcctagtacactgcaatttttataagtgtttcatatcaacttgaaaggaaagcattttttgtcatttttgagtattatggtctgttactacccttttcataaaattttcataaatagtgttttcaaatatccttattttgagattttgtttttggtttattgctcaaccagtatctgagggaagtattatttaattgtggcaaaatacaacataaaatgacaattttaaccatttttaaatacaattcagtagtgttaagtgtattcgcattcagaacacaaccagtctccacaactttttcatcttgtgaaacagaaactacatccattaaataacttgtcccctccccacagtgagagaggtattttaaactgtctctctggaatatctgttcacttatcatgattttgtcaacttttacatcatatgtattgaggctttttatatgcataaaggtgaactttattattacttcttactttataataatgtattattttaagcattttaagtacttacaaagctgattatgtatatttagtctctaaatacctgcaaggaataagtatagtgctttatttctaaggagaaatttctgttttcacctagagaatagcaaagttccctatcctttctctctttaaaaaaatcagtctactgtttgaatgtgccctattttctatgtgctggctgggtgcaggcatctctattcccattcattatatcacaaaggtcaaaggctttatctctgatatctgcaatgctatcaacaccccaaactctaaatacagagaatggaaaggagaattgttatgtattatctagtgtctctaggtgtttctaattacaaaagttgggtgttgttgttaattatcttagccagccacctggatgaattgggatgtctccatgacataatattaatctgaaaaaatacagtttgtcgatagcatttactcagtgattccagaaatgtatactgtgagcccaccatgcacatgcttatggaagtccataaatcattctgtccacttgaagcatcatggttcatacatttgggaagagggctctatttctaaagcaggttaccacaacctgcaggcaggacgcagaaactctgaacctctgaactgagcagaaaataagtgtttccagggagggaggaataagaaaggctaacgtgtatgtaacatgtgtcccatgttcactttggggtggagacatagcatttaaatgtatttcagttaggccttgtacatcaaaaggtgaagtggaggatatgaaggcgcttagtacacagcctttgtagaccagccagagccatgctgtggtgggtggtctcttattgggaaggaatgctggtcagtttctgtgttaaagctgcaagagggaggacaagtgtcaggcagttggttgaaatcactgggcaagacttttgaaagggctggtttctgccttcacccttagggaagaaagcctaatggtggttagccattctctagagaaaccttaaaaacctctggttcctttgaccaagaggaagtctgttcagtcaagtggggggcttaggattctctttatttctcaatatataagtcctgcactcatggcctagcatgatctagcaaggattcagtgtgattccactaatgacaatttatttagtcctaagtccatgtgtatggacatgtaaatacatggaagactgctcagcaaaatattggttctgtttatctttgatatcttggtggtagtttcttggtggtaggtagtttcttcttcatgtctttccaaattatttttattttgagggttgtatataaagagaatattataagcaaaccaaaaaatgcaaatagtatatatataaaatgaaaaataattcaaaatatttaattgctcatgatgtcataaaatggtagactctcagtgagtgcatatatttccttaacatgaagttattaacatatggtcagcattttcatttcaacttaatgtagtttatagttctcactatctaaattgacatttactttaaaatatagaaaaagacttctcagatgataataatggtaaggttaattatacataatggtcccattctttttttctgtgaaccaatatgtgaaatcaatgactatcttctctatgaaagttttaggtggcttagacaatgttcatgctttattagagtctcatctcgaatgggcaagagcctgcattgcttaggttagtactggacgtagtgaagtgatccatgccacatagatgcataaatcattttgaacagctgggcagtttcaggaggccaattaatcaagtggaaaccaggtgtagaggccaatgaaaagcttcccctttgccctctgaaggtttgctgaaaaatcaactcaaaaaaggtaaattaacaggagaaatggcatgcaagtttattagtgtgcacaaagagaatcacagagtgattgtcaataccttagtggggttcagaagcctgtataccatgttgcagaaggggaatctcagagaaagcctggctgtttatttcacctatatagattttctgcacagatgcaaatctactccacgaaagtcagcttttctgcactattcctgtctgctggccttctgaatagccacctcaagatacatcaaagaaatatgttttggggtgaaattttttggtttcctttagcaaaggaaaggtttgtatacctttactccttttgtatatcaggcacccagccactcgctattgcttacctgcaccccatcctcattccagagagttatttcctgcttatatatgtttccttgaactgccataacaaagtaccatagactaggtggcctcaaccacagaaatttattttctcatggttcagcaggctgggaagtccaaagttatgttgttttggccagttggtttctggtgagggatctcttcctgtcttgtagatggtcaccttctagctgtgttctcacatggccttctttaactgtatgtataaggagagagaaagagagagagagggagagagaacttcaacaatctgacccctgctttgagcctcatactttgcatatgactcccaaatccatatgcacattaataaatgtgtatgcctttaaaaaaatctgcctataatcagtttgttttataggcttcataaaaagccaccaatcctatcagattagggccccaacctaatctgatggggtgtaactttaattacctaatgtcactttaattacttccaaatgtagtctaaatgaattcaggtcatagcaattcagtccatagcttggcttaacctggtccgcagtcacaggtgaagccgagctatggactgaattgcagcccgtccgaattcatatgttaaatccctaacctacaatttgactgtatctccagtgtagccaaattggaggttagggatttaacctatgaattgggacgggctgcaattcaatccatagctcggcttcacctgtgactgcaggccagctctgacccaggtaaacagatagacttctctgtaattcagtaggataaaacaccttctccaataaagtcttaactacagctttggggaagggcttctctttccaagttcgttcttccttgagtaatcagctctagattaatttatagagttcactcatatcctatagttaatcttttatcatggcataattctttatattaaatttctgttgaaatcactctatggcttttatcttctgatttgacctacactgctacaagaacagacaagctgagaagcatgagcttgaaatataactgcccctggtgttaataattacatttttgtggaatgtatctgttataggactaggtattcattttaattatacttgtactttagttttatttaattatacttgtattatgattctgccatgtaaaatgtaagcctgtgaagaaaatcaaaatatttcacccccaaatatccttctttgacatcttttgagatggctgttcagagggtctgcaaatagaagtagccctgaaaagctgtctttcctcaggagggaggtttgcatccatagagaatctgccttgatacagccaggtttctctggggcccttcctcatctgagtctagtctgacacctttaaacttctcaaagaaacatttaccatctattttctgagagggctgctacctgtgaggtttcagctacataacaagaccagctttgctgccaggcctcctcttctctccctcccataacgtgtcccaccaccataacttgatttaccaccataacctggttttggccgtgctctgagctgccattctttctgtagcctcgaaatggcatacaaacttcaaccatctgaccctcgctttgagtttaatactttgtatgtgatacccaagcccatatgcatgttaataaatttgtatgccttttcttctgttaatctgcctattttcagtttgttttataggcttacattatcaaaacttcagggggaaaatgtaaacttccctgcaatgccagtgcagcacaaagcttagagcatatggtaaccctgacaggagggccgctgcatcggggggacctcacaagacaagtctggaaggtagggacaagcaggcagagggaatcagggtggcagtgtgggcaagagacctggaccacatagcgtctctctcaagagggctgcatgaaggtggtcactaggacaggctaggactgaggggtggtgtattttgaacatgtcgctggggcagaatgacgccagatgttctcatacccacactgctggcccgccatgcagcagctggaaagagcagaacagccttctttctgcttactggtatccttactggtaagcagaaatgcttaaagatgcctgtccattagtacagaacatatattgaagactgcatttggagagcagaggcaataaactgaaaactagcatgattctcttagtcacattttacataatagattctaataatttaagactttttttgtatgtgatttattgtagcccatgtgttacaaaggatctgagaattagacactttaattgtaatatattactaactttaatatggaatgttgttaccccatttatgggagtgaaatatgcttaaagaaacattacaatgtgtctaaagtaacttcttaaacttgcaaaaatcagagtggatatgccacataattgcactctagtgtgaaaatccagagatacaaagcaggtcagacaccacctgggataagctttcacctatcctccttttatgatcagaaattattttgcaaattttgcatttctacaaaattatcttaggttattatctaaattcaccatttaagattcaccattaaaaaaaatttctgggctgggcacaatggctcacagctgtaatcccagcactttgggaggctgagacgggcagatcatgaggtcaagagatcaagaccatcctggctaacacggtgaaaccccgtctctactaaaaatacaaaaaaatttagccgggcgtgatggcgggcgcctgtagtcccagctacatgggaggctgaggcaggagaatggcgtgaacctgggaggcggagcttgcagtgagcccagatggcgccactgcactccagcctgggtgacagaaagagactccgtcttaaaatataatataatataatataatataatataatataatataatataatataataatataatatagtataatacaatataatataaaaattaaaaattctgataccttctaagggaggaggatgtactatttgttctttaaattctcacggtatttccacattagagtccccaaatacaagagctctaatgagaaagtgactgctcagaaatttgggcagacgttttatcgttatgccttcatttctttcattgcttaataaactctaatggataatagtgaacacatttctatgtagtttctgatcaaacgattctgtgaaaatttagtcaaggaatcaagagaaagtacagtcatttctccaaaggagcatttcaacagacatttcatcaaaaacaaaatttaaaatggcaacctgtgtgaaacactttggcagaataataataataaataatttggatgcgagctgaatacatgaattattttactggggtggaggatatgggcattgcatgcttattacgtttttggtttgtattgccctacatgttctttaatgtcctagtgttttgacaaagacaggcataaaatgagcactaatattttagtttctgtcttctttttttttttttttttgagacggagtttcgtgtctcacccaggctggtgcagtggcgcgatctcggctcactgcaaactctgcctcccgggttcatgccattctcctgcctcatcctcccgagtagctgggactacaggtgcccgccaccacgcccagctaattttttgtatttttagtagagacagggtttcaccgtgttagtcaggatggtctcgatctcctgacctcgtgatccgcccgcctcggcctcccaaagtgctgggattacaggcgtgagccaccgcgcccggcctagtttctgttttcttaaggaaatagaccagtcctttgcaaacacatgttttatttcctagtaaactcatctattgctacaactgtgcaatttaagggacaaatcattcttccttaatctccgttgatggcaattccatctggtgcccaagctaatgactttgggatcaccactcttcttctctcacactctacatccagtctggaaagaaatcttattggttctatcacacttacaaaacctatcaaaaaccctaccactgattaagaactccatcgtcaccaccctgatcaaagccatatttttctctttcctggaccaatttaacggcctctggaggaggactggcccctagatggcctcagcggacccagctttcttctccccttccccatttcctggcttgcagttttagaataactgtagaatgtgctaagaatgcagtatcttgatatatagaggaactttccagaaaagcctgggctttgtcctcattccttgtagaacgggatgtcctataatgcttttgctcagtgacccacccacgggatgccctcgagctaaaacccagagcggtgtgctttcagagtccttcagctgtagtgcaaagtggagcatgtgtagatgagtatatattctctttataccagaagtaagtatagtttcattcagtgaaagtcactgtccctaatctatacaatactcaaagtttaaaaaaaatactctatgttaaaaactgtgagcattgaaagctgacttatctattcagagatcacatatagtaaagggtattacagtataaaataccaagaaagcagatcagctgatgaaaattactgattttcaatgtctttttaatcattatatgacatcctgataagttttcctgaggaattaaatgcttctgggatcttaaagtacattttctacaaacaagtcatagtgttttcttaaaataagctatcaattaaagcaagaatgtggagtagatggcattggtagatacaatcaactaaaacattgtttttattttcactccagagtacggtgagcttatattcacaattagtaaaaggaagcagagctgattttctacaacttcttctgtttcttctctcaaaatcttcagagagaggaaaaggcaaaggaatgcagtattctcccatttaagtcaacattacaaatgcaattaaagggtgtataatattgctaaataagacctcatcatgatgtgtattctatgacagtttattttgactcctttaactgagcgttgtgtgagtttctttagtttatttgttagccactcggttacgaagatcaggatgtttttagctttttagacacaatatttgtcgaagctcttcttctcatactatacttttctaaaatgaatgtgaaagtattgaaatgtgttatcgactttccataaaattctcatttacttgagcctatgtaaacacctgactaaacacacggctattcactgtcaggactttctcctcagcatctgccacggaaaagattcgattgcacgcatacgaacccaatgccagcaccccaagggacagggcaatagaaatgggaggggaatgatcaagtcaatgaatgatacactccattaatcttaatgttaggacattaatattgcttggcaactgcctaaaatcaacaataagcgatcaaccaatttgttgcctaaaagttattgatttaaccatcaataacttaacagcataaccataacaataactttaattttactaactttaaataactacagttctttaacaataacaataacagcatatatgtacatcagttatgcattaaaagatggatattttttgtgtacatctgaatggagaatattagataatgtagaaagacatgagacaaagttgataatacaatcccttagagctttaataaatgagctctctcagtcaagccacagtaacgaccttttctctgtgatatgagccaggactctgcaggtgtacagaggagataaactgcaattataaagtacaattaacaggtagtagcggtctcatttattatacacacctacgcatgtttccaagccagatgatcactaagtattcacagcaagtaatcacccactggacaaaacagcattacttcaccttctgaaaaagtagtttctactactttgaaaagcttgttggtgatgagacgaaaactgaaataggttacaattctaatagacacacagtacaggtaacacaaagagtctttccttatttaacattcttaagcatcacccaaaataccaaaaagaaatacggtaagtttcaaggttttgcataaagtactacactgagcttttaaagtgaagggcttagtcacccaaatactgtcttaggccttatagtatctctcctgagttcccagtatataatttattataccaaacagatcattctccagagttcttttgatatttctagatctctctcaacttataacctaatcagctccctcaatcccacataggcctcaagctaatctcaatcactcttcttccattcatttttcattcacttatttacaaatatgtattttgcatgagttgtctgccagcactgatttaggggcagaaagaatatgatagtacctaagaaagaccctcattcttatgtctctttaaaggaagataaaaacttttaacaaggtaaatatttaaaaatactttaaaggagaccaggcgtggtgactcatgcctgtaatcctaacactttgggagggagaagtgggtggattgcttgaggtcaggagtttgagaccagcctgggcaaaatggtgaaacactgtctgaactagaaatacccacccctaaaaaaaattagccgggtgtggtggcacgtgcctgtaatccctgctacttgggaggctgaggcaggagactcacttgaacctgggaggcagaggttgcagtgagtggagatcatgccactgcactccagcctagttgacagagcaagactctatctcaaaaacaaaaaacaaagaaactttagaagacacaaaatgctataatagcagagagtgacaattgctacaaagaaaataaaatatgattatggaaaacaaatgaactggttgatccaactcctgtctgtgtccactgctaccattttggagtgagctcttgttaggtcaccactcacccaggctccagtgataccctaattggtttccttctgttaatggccttcattgttttttctgcagcgcattcagtctgtcaggttgggttctatagaagcagagcatgcaatagcaattattgagcaacttttcttgagagaataaccttatgagaggggaatagtaagtagggtgagacaagggtgagatctacctaagccaggatgatctcaacacaagactggctcagcctgacacccagagttttggagcatggattgcattacagagttggcctgacgttgaggctagaggaatagctctttataccatgtgtcagtcagtcactggctacaggttgtccaggtgaggcagctcccttaagtctggagaagtgctcaggagagaacagggcacttgtgagcccttagctaccaacaatagtatgggggggtgcaatgcagaggcctagtaaagtgggactgaatagagcagcaccctttaatttaaaagaagaagaaaatggatattgattagaaacacagcagcatctgccacagttagaaaaagcatgactatgtggtgtttctgtaagaacatgagagaatgtcagtgaagcacatcataacagtgattggagcatgagttctcagtcaatggcagttattttgattgtgacagagattgagatgtttataacttgaatagctggcactagaattcctattacagaagaattcctaacgttgaagtactagtttgatgagctgcttgggataaaattgaaacttcaaagttatgcccattggcaagagttaaatcagcaaagggggcaccaaaactatcttgtgtgagaaaaggagaccaatttagtttttgctcctgagaagagaaaagacagaagagaagggaggggaaggagggagatgcaggaaggagagccagggtcatgccagaaaagctcagagggaattagctggccaagcagtggggaattaacttttaaagaatataaggcttggcctgggtgcagtggctcacacctgtaatcccggcactttgggaggccgaggcgggtggatcacctgaggttgggagttcgagaccagcctgaccaacgtgaagaaaccccatctctactaaaaatacaaaattagccagatgtaatggcacatgcttgtaatcccggctactcaggaggctgaggcaggagaatagcttcaacccgggaggtggaggttgtggtgagccaagattgcgccactgcactccagcctgggcaacaagagtgaaactccatctcaaaaaaaggaaaacaaaacaaaaaaaaaaaaaaaaagaaagaatataaggcttatgtttacagtaatttttgttacacctccatatcttctgtaaggttattgaaaataaactaatgggttatatgtatatgtgtctttttttggtgaaaattgagggagaaaataaatcttatttatgagttaggatgtttgaatcatagagaaagaataatctataaagtgaagaagttggaattctcagccagaggtgactgtactatctggaatatcctgagaaacagaaccaatagcagagacagagggagagcgagaaagacttactatagctaattagcttatgtaattctggaggctgagaagtcaagtttgcagttggcaagctggagacccaggagagccaatgggagagttccagtctgagtctgaaggcctgagcaccacgagagtcaatggtgaaagttccagtctgaaaactggcaggctcaaaatccaagaagagccaatatttcagtttagtctgaagacaagaaaaaagtcatgacccagttcaaacagccaggcaggagttttctctttcttactggaaggtcagagtaattttagttctattcaggccttcaactgattgagtaagggctactcacattagggagagaagctcgctttactcagtctactgattcaaatgttaatttcatccaaaagcgccatcacagacatagctgggataacgtttcattaaatatctgggcacctcatgacatcgtcaaattttcacatgaaattattcatcacaagtccacctcttgtcaacttggcatccatgcacatctccttaaactatacttaatctctaaataaagaaaatagcaaggccatgcttctgtctaatatatcatcatcccatgtacaactgaagacacacctaccccttccccagaaaaggaggtataatcctcgaatgatgtttacttttctccttgatatcctgtaacttaaatgttataatataaaatcaacaacacttaaatgcaatgatatagtcaatacctcctacattaaattataagggaataagacagcagaaaaacaataatatttgcttaatgcacccacacacatttgcatgtattcataacaaaaaaggaggaaatgctgataacaatttcaatcttgatttctgtaagtggtcatgtggtcatagctggtatttctagctaccttcttccactaagcacctcacttcttccactaagcacctcacttcttccactaagcacctcagctggtcgtgattatttccttgttgggatgacccaaggcttcattcctgaagggtctgggccattagttgtcctgcctggattaggtggttgtcattttccattgaccataagtacagaatattataatcccaaggacaccctaagggtatatatattgcagacacacccttccttatctccatttggaagtacgagtccaagttccccttgccagttaagatcaataaccagaactagcccagtaactctcttccttgcctattgatttacaggcatgaggaatccaaagccactgggtaacagttttaatttccagttctaaaaaggcactgttgtgtctcttggaggaagcaatccttcatttgaaacagacttctaggccagcagatcataaagttgtagaatcaagaggcaaacattttgctagtaggtcactaggaataaccgtgagtgagaccactcccactttcttcccttgattcctggacctgtgaattctgccttttggagaaacagcatcatattttggatgctgatttaaagcatacagactcctgaggattctttccccagctcagtactgccacctggctgacactgtaactgagtctgcaaaaggccatttcatcattctaccaaaccagctacttcaggatggtagaaaacatagtaaagtcggtgaattccacgaacatggacccattgctgcacttcttttgctgttaactgaattccctgatcagaagcactgctgtatggaaaacaatgactgtggttaaagcattccgtaagcccatggatggtagcttgggtagaaacattgcatgtagggaaggcaattctatatccagagtgtctattccagtaagaataaaacactgccctttccatgatgaaagtggcccaatgtaatcaatctgtcaccaggtagctggcttattaccccaggtgcatatcaaggattcagagttggtctgtgttgcaggcatactggaccctcacagtggccatggccaggttggccttggtgagtgggagtccatgtaggctaagtctccatcctgccactatggatactttgttcctaagtctactgggagatgacagaagtggctggcgaaagaggctgataggtatccacagaatgggtcatcctatccacttgatttttaaaattcttctctgctgaggtcatcctttggtgagcacccacatgggacacaaatatcaccatggttttgtcactcattcagagaggtccacccacacatacctctttcccaggtttccttgtcaccaatcttctaattatgtttacacattatgccatttgttctttccaagcaaagtgaacaacctggtgcactatttgaagttgagtccactgggacaacttctcttcaccactgtccagggatgtcccagagaggggctacagtgctgcagctatccactttcagatggttcctgaatattatgcaaaaccctctgtaatccaggcccaagtcttctcttctttagtcaactgataatggggagctccccatgggaccataggtgcaggctgcgagagaaaggtcagtgtagcagatgtggggaccatgggcttttgggtcactttttcacgtaacttacttgtgcttcagagcctgctcagacctaatcatgtgtataccacttccattagatgctggagtgctcctctgcatgcctagcttcatagcttggtgaatcagataacacccagctcatcacatgcagctcagatcacatggcaacttggtggcccagggttacgagttctgtaactactaaggtctagtagcaggccaagagttgtttctcaaaaggagaggagttattcgcagaagatggcaggactttgctccaacattctaaggccctgcgctgttactcacttatagggcttgtcaaagtctccaaacagtatcctatctgccactggcacttcaagcaccattggatctgctagatcatacggcccaagcagcagagaagcttgcacagcagcctggactgctacagagcctcctcttattctgggtcccactcaaaagcagcagttttctaggtcactcagtagatggctcagagtaacacacgcaaatgaggagtatgatgcctccaaaatccaaagaagtccacagggtgttgagtctctttttttcgttgtaggagagaccagaagcaacatcaccttaaaaggaatatcttgatgtgcccaacatcactggacctctcgaaattgtactgaggtagaaggccccagcattttagttggatttattaaccactccctgacatgtatgtcttaccagtaatgacatcagtgtaatggaccagtaatatcttgtggaagtaaaaggtaatcaagatccctgccaactaaattttaacatcggcctagaaagttgacatatctgtgaggcaggatagcgaagatggattgctggccttgtctgctgaaagaaaattgcttgtaatgagacttatgaacagatacagaggaaaaaaagcatttgtcatgtcaatggctgcatatcagaggatgtgttaatttattcaacgaaaccacatctgatacagcagctgcaattggagttactatctagttaagcttactgtaatctgtcattctccaaaattcatttgttttctgcacagttcaaataggtgaattgaatgggggatgtggtgggaatcaccacccttgcatatttcaaatccttaatggtagcattaatgtttgcaacctctccaggaatgcagtactaactttggtttactactttccaaggcagagacagttctagcggcttccatttagcctatctcaccataataacccttgtcccttacacaagttaaggaaccaatgtagggttcttccagcttctgagtatatctattctaatcatgcattctggaaacaagaaataagcacaggatggatttcgggactcactgggaccactgtgagacagacatgggataaaactccctgaatcacctgatctccataagtccttactttgactggtgacccacagagggggtttaggtgtcctggaattagtgtcagttcagggccagtgtccagtagtttctaataggtctgattatttccttttccccgttgcatagttaccctgctaaatggtaccttacttttggggaagttgtgaggaagtttaacagtgtaattttttttgcattgtatggtgctccttcctcaagagtacttggcctcccctccagggggttctggggctataaactggctctaatctgggaattgattgaggagttgtgactctggtctaggttaaacttatattcacttgacctaggaattttctgcttacccagtgatacagtttggatatatatccccagccaaatctcaggttgaactgtcatccccagtattggaggtggggcctggtggaagatgactggatcatgggggtggagttctcatgaatggtttggcaccattcccttggtgctgttctcatgagagtgggtgccttctcatgagatctggctgtttaagtgtggcacctaactctctctcttttgctccagctttcaccatgtgacatggaagctcctgctttgccttccgccatgatcctgaggcctctccagaagcagatgtcagtgctcatgcttccttgtagaaccatgagctatttaaacttctttccttataaattacccagtctcaactatttctttatagcaatgcaagaacagccttatgtatacagagaaagtaagaatttagtagtcttccagagtatttcacctctagaaccatcatgctcaactaaccaacaccataaatctgcacaagtgagatgattctgattgctgtcttgagtctgcctcccttacaggaaccacacccactctcactttggtaccaccctttggctcctgtcatcctgggatccaattactcccactgtctagatttcccaaacagtgactgcattctccactgtaaggtctggcaatcacaaagctcttcagagacgctgaggctctccttacaaattgatttctcacaatagcagtgaaaagaagtacatcttctgttttctcccaatgagggtggttagatctgaaatggcaaatctattctaacattctgatctccctaagcctttgatgctttcctctacagatggtcccctttaagatggttcctgttgcaatggtgtgaaagtgatgcacatttagtagaaaccacactttgaattttgaatcttgatcttttcccaggctagatctgctgtatgacactctgttgcaatgctgggcagctgcagggagccacagatcccagccacccacaccatcacaagggtaaatgaccaatactcagctgcgtactgtgagtgtgctgtgttgccagtggtttttattttttatacttttaatgttttaattttttcttatttttcataagttattgggggtacaggtggtatttggttacatgagtaagttccttagtggtgattcgtgagatgttggtgcacacatcacccaagcagtgtacactgtaccatatttgtagtctttcatcccttgcccccctcccacttttccccccaagtccccaaagtccattgtatcattttacattctcaagcttcatcagaagagagagaaaccaataaccctgtcactataacctctccatcagccagcaattaattttagttcaatgtttcaaactttcttcaggctccgtgcactttcagctgtgtacattaatggttagtacccatacaagtattctgtttttcactttcagtatggtattcaataaattaggtcagctattcattactttattataaaataggctttgtgttaggtgattttgctccactatagaataagtgttctgagcatgtttaaagtaggataggctaagctatgatgtttggtaggttaagtgtattaaatgcagtttgacttgcaatgttttcaagttatggtagctttattgggatgtaaccttatagtaactagaggggtatctatacattcaaccaaggcaggtctggcatttccaacttactcactgtaggccaccttttggtctaggctttagtcaaccacagaaagtgttagagccctttctgactcctgagatgcacattaactgtataatctatgcttagtaaaagtaatttcagcctgaggtaagttggtgttcctccaccaatatctcacacacttaatatccattctcacatgtttcctaggtttctgtctgtataattttaaaaactcaaataattattgtagagtgtagcacacctcctcatgggccacactttatacctcacctttaggggcccgctgagatgagtctagttctagatccagaagcaaagaaagatggtaggcatggttcctgagaatattcagcattttcttgatggcagcttcctcaggggaggccactaaaatttcatcagtcactaagaggttactctcttcaaatgggggtagagaggctgctccccctggggctggggagacatcttccagcagaaaagaacttagtggttcagtgtttccagcttcatccaggtcttccctcacatcacatccccactccaatattcagattccattccttcccaatcaatgccctcactttccccataaatactctacaaggctgggagttcaaacttacattgtaattcagccagtcacaggatgagtttctgggcttcattttcagcaatcttagaactgaaattacaggagataaatgtctccttcagggcacacatagaagctttcagatcatttaggtagcatttgagctgggaattttaatcgttaagctcatctttctctttctatactttgtccagcaccattaggaacaatcagtcctaaactgttatattcaatagcttgtcggaaatgtttgaaattaccatatacacagtcatccatatccatgctttttgtaagtagttgattaggactatccaagggtgatattttgcatatttctattgccaaatcatgccaggtactgtgagtgctttctttaccactggaaacagaaccactagcatctttaattctaatcagattagaaagccaattctggaaacttcagaacaaattcaagaaatttattcttaaaattttgtttctctagaaccactgttagtactaaatcatgctaatctcagtactaatctgtattagtcacgtaccttccaaaagaaaaaaaacccagaacccactagatgctcagatggatatgtggacacataggtacatttattgtaagaaattggtttatgtgattacagagactgaggagtccaaaatttgcagttggcaagctagagacccagggaagttggtaatgtaggtccaccccaattccaaaggcctgaataccaggaaagctgatggtgtaagttccagtcccagtctgagtccaaaggcagaaggacactgatatcctgttcaaagactatcatagagaaacaattatttattactcaaactttcattccattcaggccttcaaggaactatatgaggtccacctacaatgtggagagcaatctgctttactcagtcatacctgggaggcttcaagacttccaagaagggtgttaaacttccttcagacatggaattaaattttgattcaattttatccaactgtcttgggaaaaggggaatgcttcacctactggatggtttaaattattttgttgtaatcattataaaaatatgtacatctgtggacaaaaagaaacaatgaatgagccaaatacatacttggaaattcacaaaaatgttagttttatatagacataatctgataagcttggaaattttaaaaaaatgcttttcgaataagctcagtgtttacaatagtcttgtttcttttacttgtcaaaggctctgccatctgaaagtattcaaaccatgagtttcatgggccctgcctgtgagaaaatgtgcattttccacataaaatccatttccttgtcagataatttacaactcaccctgtttaaacagactctgtatttaaagctagaagatttatcacgcagcaagttcaacctcaggaattccatataagtccacaagcgcatgtgtctaaaaactgttgagtaagtaaattcaatgatgaaaactgtaatttatatcaaggatgagaaatactctctttgtaggtctattgtcaatgactaatatatgaagaattaatgcagttgatcatctaaataatgctacacatgtctgtttccattggcctgtggacaagaacatgtgtcagtaaaaaaaagagttttgaaataaatctcagatattatgattgtttcattttctctaataaaatgtgaacatttattcattcttggaaaataattttgaatagaggtatattcaggtatatgtgttatattcctttgttaactttataggcattagtttcattaattaaatataatgtggctttggtggaatgaaaaaacactagcctgaagctgaactggtcacttttcagttttgtgtttggtgggtgtggacagacatgatgtaattctttggagaattgagacaacttgggagatttacagggcacatgtgattgtatttccattagtgaaattgtcacacattaaagacagagtaggcatattagagctaaaatgtattcaaaggacctttatcaaataaatgtcagttgtggaaataaatgttaagctggaatatgtgaaagacaaatggaaaataaatggagaccattcattcacggacaggtagagaaacattcagtgaaagctaaaaagattgaaatagggtcggctgggtgcagtggctcacgcctgtaatcccagcactttgggaggccgaggtgggtggatcacgaggtcaggagattgagaccatcctgactaacatggtgaaaccccgtctctactaaaaatacaaaaaaaaaaaaaaattaggcgggcgtggtggcaggtgcctgtagtcccagctactcgggaggctgaggcaggagaatggcgtgaacccaggaggcagagcttgcagtgagccaagatcacaccactgcactccagcctgggtgactgagcaagactccgaccgtctcaaaaaaaaaaaaaaaaaaaggaagtttgaaacagagtcatgaaaggcgatttatttgttttcagataagtgacatttagataacaacttgaaacgttgataggaaagttccagtaggatgggaatgattgaaagaacaagagagtagggaaataattgacaggagatgccaggaggtggacagagagcacaagtagacagattttactttcccggagggattcctcaactggattggaagggaaggcaacaaaaagtgactgggacatagcgtgattttaaaggcagaatacatcaaaatctgggggtagttgatgcagaagactttgaacaaatgtgaatatgtctttatggaatgttcccatcctacaccaatataagtgtgctgctaaaccagagagagctctctggaagggacttccttgctagtgttacaggaaaggggtccctatacagaccccaagagagggttcttggatctcgtgaaagaaagaattcagggccagtccacggtgcaaagcaaaagcaaatttattaagaaaataaagtggcgaaagaacagctactccatagacagagccgggagttcccaaaaggaagaagaggaacgcgtccaccctaggtacgacacttgtttatatataggataaataaagatcatgggaagatgtgctatgctacaagggtttgtgataaaggattaattttcttatgttttgcaaggatcgatattattatctttaaagcaaaattaggaatgcttctgttctcaagatatcaggatatcaagacaatcccaagtctgggccagtttagtaaacattatcaatctgttctcttagcagtaaacatctagaggctaggaatgcctaactttctatgaatgcagcccagcaagtcccagccttattttcttagccttcactcaagatggaatcattctggctggaaagcctttgacactaggaaaagcacaaattgtataagtggaacaatttggaaacaagtgtcaggtagtctttctttagacacaacacgactttgacataacaattgcaaataatgctttgcaaccatgtcaatagtggtatcttgaggggaactacagaatttgaaaataaatgtactctttacctaattactaattttttcatttattcttatgtcttacaaatatgattatatttatttaggaataaaaatttgtttcttaaggaattcatctatttttgttgtagttcccattggaaaacacatttttttttgttagaatagtataatcccaataagtgacctgtattcatgaaggctaagaatagaaacaagtaatggtagctcagaggctcaggttggaacataatggctctgcctcctgagaagagggaaggtctaatattacattagaccacatgtggcatctttatatttgctaagggatagttagtgcttgcatttctcaaaacaggcttacattatcacaatcggcgttcaactagttcaaaattcaagcttagtggatttttttccacagtagtcatgctaatgtaaatagcacatttgcagtgaaaatgttccagttttattcttaagatgttttagggcagtgcttctcaaattgtaatgtgcaagatccttatgatcatgttaaatgcagattccaagtcaacgtaggtgtaagtagggaagtctgcatttcaaacaagctcccaagtgaggttgtgccttgcatagtaaagttgtcgtttgcagttagatacccgcttaccaacagaaagtgaccagttaagaaggaacacatgctcaccaaatgcttatctcaataaatttctttacacagacttattaaaatcaacttaacataggatacacatgacacatataacatccctgtctttagaaaaataaattgattgtttttatgtctgacatatatgccaaataaatggaaaactgaagataattttttggttaaaatttggtcttcacattaaaattagtttgaagggtatttttctgaaaaaagaatctctctttctccatatatataatatttaacatttaactttaatttgaagtaacatttgcaagaaccaggctgtaaggtagtttccagggaccaaattgttaaaatagatgtttgtaatcaatacttaactgatgtgaacattttgtattatgacattaaagagggaattcttatttgaactctgcattagctgaaagttcagtgcattctgtagctttcatatgaatttcttccactacattaggttctagattttaatatttgtagagttggctgcatgcagtagggaaaatgccttttgctcttagaagtcatgagaactaaggggtcacaaggcgaattagtgcatttaagccagatttcatcctgtgaaatccagcagcagattttttttttttttttagccaaatttagttactttaagaaacaaagaatagaaattcctttaacaaagaaaattctgtctgttaatgtagttgacataaagataataagatattgaattttttaatgatttctttgagtctaggatgtgcccaaggaaacctgtcccttggcaggaaaatagtagacattttcttgaaattatcgactcatgcaacaacttggataaatctcaatggcgttatggtgagtgaacaaagtcattcaaaaagttcatactgtattgattccattatatgacattctcaaaggataaaactatagggatagaaaatagatctgtgattgccagtgcttggtggcataaggaaggctttgataaagaggcagcatgtgggaatttttttagggtgatagaaatgtatcttattgtggtgatcgttatatatatgtcttagaatttatagaaatgtgcaccacaaaaaggtcaattttactgtatgataattataaaaacaaaagaaaatagaaaaaagtgtgagacaaaaaatattaatttacctcagaaactaaatgagattttcccattgtatggagctgaggatttatgaaaattgctttcttccatatgcagccaggcatgaagctgacttgtgcctccattccctggaagaatccatcggagaaatggtggtaatagaagatgtgactctgtttgctggatttagatgccattacttcaagagcacagagtgcttcatgtagttgcagacagaaactataatggaaatattacttaacaaggtatcactttatatttcttctttctttttttttttctttttttgagatgcagtctcgctctgtcgcccaggctggggtgcagtggcacagtcgaggctcactgcaacctctgcctcagcctcctgagtagcttggattacaggcatgtgtcaccacgcccggataatttttgtatttttagtagagatggagtttcaccatgttggtcaggatggtctcgaactcctgacctcatgattggcccacctcagcctcccagagtgctgggattacaggcgtgagccaccgcgctcggccactttatatttctttgaatataatatcccaagtaagaatttgggattgtggaccgggcatggtggctcacgcctgtaatcccagctacttgggaggctgaggcaggagaatcacttgaacctgggagatggaggttgctgtgagccaagatagcgccactgcactcctccagcctgggccacagagtgagactcggtctcaaaacaaaacagaatttgagattgtgtttaaatatagtaagtacatttgataatcaactgcatggcagtcaaatcttaaattctaaaaccactacatctctgagtcaaaaagttgtatttgtggtagtagtctaaaagaaaaattctcaccaacaacacctcagggcattgtaaaaagtgttgctgattcttttcattagggtgataattgctaattaaagcctaatgtatggtggggttataagggctttctttccctccatgttggaataaaacacggtgtaaggacaaagctggtgtatattaaattagccctgatgcagactggctttccatattccgtataaggaatctgaggtttattttttattttatttaatttttttctgagatggagtctcgctctgtcgcccaggctggagtgtagcggcgcgatctctgctcacctcaagctccgcctcccgggttcacgccattctcctgcctcagcctcccaagtgtctgagactacaggcgcccgccaccaaacccggctaatttttttttttttttttctgtatttttagtagagacggggtttcaccgtgttggctaggatggtctcatctcctgacctcgtgatctgccctcctcagcctcccaaagtgctgggattacaagcgtgagccaccgcgcccggccaggaatctgaggtttagagcgttgaaggaatttgcccaaagtccaggcactggactgggttctcagcaagagaagccatgctgagaacccagtctcataactccaagcgtgtcttgacacagtcaggtactccctgctctctgctaaaggaagtgagtagttaccatcatttagtcatccactcattcaactagtatatatcgaatagaacttaggtgacaggtgctgctcctggcagaaggcgctgttctgttaatagatgctggggttgtttctctcattagaaatatattaaaccttgtacaaaaacaaatgtcttcctttgagtttcctttgcacttccagagtttagctaaaaatgcctatcaagtgaaagcagttttctgctcggaatctgcaaataaacgtggattctgagaattattattttagaaattaaatcttcccttcagttatgtataaataacttgaaattactagaaattaaaatcaaagaaaatctggaattactgaaaattttatttggagtttattaaagaatgaaattatacacacacaaatacacatatacacgtatactaataaaaactaattctttatatcatgccaacaaaaagtaattctattgtttctgttcctacaacacctagctttactatttaattttatgttaaattttgattattcacatttaaacacaatgagagtgctttttggtcattgaaagaacatgatagtatcataaataaatattgtaaaatattaaatattactactaataaagaaactaaataattaaaatactagtaaatatggtctcaatcattaaatgtaatgacaattttattttgatccttagcccagactgatcttttcatacaacgtcgttagaaggcactttgatttatattattgtttcagcaccatgctggtagtacctgctaggaaataagcaacttcccacatcagaacgggcaatgggaacaaccagaagccgcatggagatctggcacgggggccagcgagggcagaacgggagtcagcattgcgctcatggctctccgagagggtcttggcggtggagcacctgaggaaatgggagagttagccatgaggcctggtacaccagcatttcctccacctttcctatatgccaggggatttacaaaagatttttttttataggaacaaatagactatttatatccccaacaatcacctttttttttttttttagacagaatctcaaagtcagttttcagaaagtatgtgaggatttattgcgttccaggtaaaagcagctgcccattacatgaaatctttttttttttttttttttttttttttttttgagacagagtctcactccgttgcccaggctggagtgcagtggtgcgatctcagctcactgcaacctccacctcctggattcaagagattctcctgtctcagcctcccgagtagctgggattacaggagtgcaccaccacacccagctaatatttttgtatttttaatagagatggggtttcaccatgttcgtcaggctggtctcgaattccagatctcaaatgatccgcccacctcggcctcctgaagtgctgggattacaggtgtgagccacaccgtgcctggtgcaccaatcacctttgacacttcatattatagcagagaatgtctttcctcctgattattcaagaaaaaatatataaatgtatacattcatttctatacaattatgagctaaacaatactgaatatatcttactagatttaaataaaatttaagtaacaattttatttcatcatttctaatagtacgagttaaatagatactatgagtagaatttgttgtatggataaatggaagtaagcatggatatgtttgtatataataaaatacagtcagcatgaattttatccaatttttaaataaacatagagttataaattaaaattaaccagccataccaacccatttgaatctatagtttcctacaagggaatgaaatgcgaagtaatagcgagcctccaaatgttttagtcacgcagtgtagagcacccacaaatcatctcacccctctgtcggggggcgctgtggggtgccccggctttactagtagtgcttctctaaactcatgcctgcaccctttcttctggaagcctgaacaatgatgcagagatactgttttctttgttgtagaaaacagcagaaggtctgtgctcacgagggcaatattaggtcctcatcagctgtggcttgctatctccagcacatcaatgaatggagaaaataagatttaaacaaagatcagtgtctccattctctaacattttactcaaaatattggttaggttagactccacacccaccaaaacccaaaagatattccatctcacagatgctctacattctttcaatacagaaaccttacgacaaagcctacaatatacacttgttttagtaaaataattggtccagttagtaaaaaatgagttgaattagtgttctccctctcacacattataactataacttttttcaattacacaggtgtttacagaatttatctgaggtgctttctgtgtatctctgaaaacaccttcataacagtaggcacaccctggctagtggttctcagccctggctgctcactggtatcaccaggagagctctggacatactgaggcctgagcccttcccccagacactaatttaatgggactgtggtggggcctgggcatggatgtttttagaagcatctgctgatagataagcaataaatacgagtttattaactacacatggtgatttgatttccatggattcttccctgattttctgatccattggcccgtatatgaacaggctaacttctagtgtgtgaaaagactgacaggatattaacctggctaagtgtctttgaaaatataaatggagggaccatgccttaaaagagttatgaaaaaaaaaaaaacagaaaatatgcacctgagaggggcgcaaaggaagcaggcgaatgtggggtcttggagaagtcactcctgatcttgagtttctatgagtacacattaaaggaagtcattgcagttttctatgtactgtgcatttggatattttcacaaactgaaacaataattcgctgcttcgggaaggggaacagataatgtgttctaacgtagcatctttactttctctattattagaaacattttaaaaatctatctttctttggcttggcatggtggcttacagctgtaatccagcactttgggaggctgagactggcagattgcttgaggtcgggaatttgagaccagcctagccaatatagtgaaaccctgtctctagtaaaagtacgaaaaacattagctgggcgtggtggcgcatgcctgtagtcccagctgcttgggatactgaggcaggagaatcgcttgaaccccagaggcagaagttgcaatgagccaagatcatgccactgcactccagactgagagatagagcgagacccccatataaaaagaaaaagaaaaaaattatctttctttggagtctgtcaaatgtattaccactttattattagtgaaatttggtgagttatatcaaatgatcagtgataggagataatatctacaagatttaatgattgactatagggaaggagaagagaaaggaatagatttcttcttttttttttttttttttttgagacggagtctcggtctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagaaaggaatagatttctaagtcaaattccattgataatgatgagaatcatagggggaggagtcaatgggtaggagaaaaaatatttggtttaggacatgctgaatgtgaggagcctgtgataaaggataggataatatgaaaagcttccaaaaggagtacaccagattatgagatctaccttttccccaaacttataaagggaaaaaatatcaactccattgttaattctccattgatcctgatgaaacgtcagtactgctgatgagatgtaaaaataaaaagcagcaagactaaagttctccaagattcctctaggatatgtttggtgtctgcatttgcatttattgttatttaatctacgttattcaagatgctttctatttggaaccccaaaacaaatggttgaatgggcttgctctgactatctatttccacagaacaaccacccaaaatttagtggcttaaaaaaatgacagcatttattttgtttatgaatatgcaataactccgcatggtttggggatggctcaaagaccaggggcgaggatcatctgcaggctcatccactcacacatctagtggttgatactagctgttggatttccacgtggctcttcagcttcctctcagcctagtagatggatccaatggtgagtgtaccaggagagcagaagggagccaggcataggtgtctggcctttcctaactgagctgaggaagtcacatggtgtcatttctaccatattacagtcattagaagtgagccagtaaatctggctcatattcaaagagagggaaattagactctatttttaaataagtgtcaaagaatttaagggcatattttcaaactgccagagcgatcgcagaaggctctgccacctacaaccaactatttctttgcattttaatagaatttttaagagaaatcatagctgaagctgcggttatattttggagtcgtcacagtaaaagaaataaagtacatgtaatttgatatttcagagcattttttccctttgtccaagacattttaaatttgaaatatggttttggcagttttgtaagagatattatgtaaattgaaaggagaagatgagttttggagtcaatcttaaaaattcattttggagaagcacaacatttgcacagcatccgtctgatttgatgccgtttgtataaaagagccgtgctttcccaggagtggaaactacattattggaaaaatataggctccttagggtaaatgatagcacaaagatagtaaatgtcttttcatttgaaataacctttgtggaaatgctattattctcaatatattgtaaaagagatgaatcagaacggtgttagaaactatttaatggatcatctatctgtgacatattacaaagctaaatgttgaattagcacttggctaaaggaggcctcatggccagaaagggttcagctttggaatccacaactctggttttgaatcttttttttttttttttttttttgagacggagtctcactctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggcctggttttgagtcttggtttgacttttctttgccgagagatcttgaagttttgttatgaggattagagcacaattcctggtatctgctccctggctgacactcagaaactgagatttgtcattaagattgtgatggtgagatgatgatgagaaattgtttgactatctcaggaatagtagaaattattaaaatattgaattgtacccatgagactatgtggccaggcaagaagaatgagataggccctttcttcaaagtatatgatttttttattattgaagaaattattcataaacacttgaaaacaaagcatattcaaagttttaaactgtacctaaaagatagtgccataggagatgtgagattttgctaaatattttgaccttaaaatgggaaactcatgaaatatgaattattttaagggtctaatttattgcattttttgattcatatgaatttccctcgacaatgttaattcagttatcaggacaaatgaaaaagtaagctttgtaaattaaaatacagaaatatttacatattgtggcttgtctctggaacttttataatgggatattatattttaacataatgttgatgtaaaatattataaccaagatatcagcaatatagttacaagttgttcttttgaaacacagggtcataactcacaggtacctgatttcaaaatacatttggcataatttacaatttataaatctataatctctttaaggcgaattgttctaatgcataattaatgcactagtgccatgactaacttttaagaatgctgcattttccacaccagttcactgataacctaaaatattgcagtcattcttttaagaagttgttaaaaatgtctctgtaaaatataatggcaaatgctggctattttatgagtgggaattacaatagtaaatagtaaaacaaaatattttccaagaataaatgtgcttcatgtgggtttgatcagcacatctgattgaagatttgaggtgagatacattgtccccattaagtttaagggtttcagcgcaaaatcagctgatctactctttgaaacgcagggcatttgtgaaaatgccaaacgcatctctattagaatctcatccatgagcaaatgagtaatgtaagtcagatacaatggttaattctgtggtttgccaaatctgtacacttcctgttactttgtagattgtaaaataatgatgcagcattcaccctaatgatcaattgttttccttactaaaatgtaagcatttaaaagatctgcctaattttttctaagtgtatgttaggcagatctatacttcctactcctaaagcattcttctaaagcagtttattagagcgcacactaatggcttatcaattaagcaaacatgatcagtattgagcacttgctctgctccagggtgccggtgctaggttcacgtgcatcagggagacagagttatagtcctcatgaagcttacaggggggcagattgattgaaccgacacctctgattcccttttaagcctgtaagcagctgctctgtaaagcaggtgtttcaaacacaaccaccttcagagacgaggtgattctgttgagtgggtgaagcaggccaggcatgaggccgcaagcagtggtttagaccagttcattggagaatccctgccttattaaaaatatttccttccaaaaatgtgaaaggaagacttgtccttttccacaaatcatttagaaagcttgctttgtcacctctgcttctaaggagtcctggttggtctccaaaaggaagctttctctaaagaacagtgtagtacaaagtaagatgggacaagactcagggggcccactcctgagctgctcagccacttgcccacctcaggtaaacactgagcctggtggtctttcagtcattccaggtctgatgttctacagttttgtcaggttatctgggagaaattttgatgctgaagagtcccgaaagtaggagaagcatttcaaactgaggcctaagatgttttcaagttgtggcagagttgccttgaagaaggtaactcgggctttgccctttgcccttttgccctttgccctttgccctcacctgcagcctgcacatccatacctcacctctaatacagcaacccctgtttgacatgttgtatatattaagcttttacttaagatgtcatttaatgaaaaagattttgctgcttaaaaagcagtggagaataatagctagcctcttgagtacacagtcccgtaagatttgagcacatgatttttagaaaaagaatagaaaataagagaaaattataacctcactttacctgtcgggatattgacatcactgtcagatttcacaaagccacatgtgcatctggtgaaatcccagatccaccctttctaactgtatgctcttaggtagccaattaatctttctaggactcagtttttcattcattaaataggaaacttaacacatagggcttttgagagggttacatgagtcaatacaagcagagaacttagtacttcctctgtcacgtagtaagcactccttgttatccttggattttgtggtactttggaggagaatggcactcggatctctgttggtataatttttaccaaagtaaaatctggttgaaatagcattcagatttaggcttaaggagaggatatttcttagaaaggaaggctaagcttaatgggggaaaagagttatcagtgaggccttggggcaggggactgactccactgggcattacttgtgcaaaagggataaaatgtagagagagtttttttttctggtatattattttattccattaaagtcagtgttctacttttattttgtaaaatcatatttctgagtcctgaacaaaagactttcaagatagattttactgacagagaaatggagtgccacattccatagctttgcatatagagcttcacatgcaaagctctttgcatctcaagggctaaaactggctgacttacagcaagtagctttcctgtaaactgtaaagtagaagcgaacggagacagctatgaaggtgggaaaaatgcctcctgcagaagaagagcagacataggggagcataaatagtataccctgcctggaccctgagaaggacccagacctgcatgctgcatattgagacagacatggctgtggattctcattacttgggattctcagtgatgcctcaatccacaattttgtattaataaaaaagtctttaaaatatttgcatctaggaatcaaagtgtcattcaatgacttattggtcctcaaatgacagcttggggttgtactttatcttctatatcatggagtaactcctacactatattcattccaggagaattaactatgtcaattcttatgttcatctcttccttggctgattatttgttagggaaaaagcttttgcttgtttattaatttgtctccttcctactcttctgattattattttgtaatcaaaacaggattttaaaattcatagacactaaaatattctagacttttagcactggtttctaatattttgggaggagaagcttcattttttcttgaaaatgaaggtgtaaagatactaaattccttgagtggaacatctgggcttcatagaaactttggagctatatgatagttagagagaatgtagacagggttcctcattgtatagataagagaggctgagtgacttgtagaaggtcccccagtgagtagcagatcctggatgcatgcagcattgctaactctgagagctaagtcctcatcatgtccccaccttcaccacaccacacagttcaggagaaggggcacatctctagaatatggctggaaaatacactagggaaaactttagatccactagcagagtccagtgctcctcttggagaaagtgaccagaaagaataaagcacagttagctgttgaagaaaagctgatttctcagccagattatgtacattagcatccatgttagttacctttgctgaataattctctcctcaactgagctctctgaagaaacctccaggaattagcagggctttgagtagagatggcatatgtttgggccctgatgaaaatgataaaattgtggcctggttgcagcttgtgtgctgaaggaagagcatgatgcagttcattggtatgaaaaatgaatgcaactaaaacctaaacattaaaacttggcctttattaccaaagtgaaagtgcttctaattgaggctccctgggttttaattgttcttcaggaaaattagatgttgtcaaagtagaaggttaatgtctgttcacagtctggagtttttggaataacttccttcacagcgtgtgtgttttaaacataaaaagggctttttggtttgtatatagttagtgggattacaactgcctcactagatgcttacaacaaatatttaagaaatccataaggtctactatttataacagaataaacatttaaatttaagatattttgaccattttggtaaaacatttaaaaaataaactatcatgaactgacaaaaccaacatcatttaaaaaaattcaacatggcaaaaactttatgagacttataccatagaccaaatttgtaactttagccttgatacattactgcttgtaaatagaaatgttcttactacaaagtgatgtgctcagatacacccaaaatttattaaaggcatgtcaacagccaaattctgtggtacaaggtttttcatacattattttacataacctttgaggaattccaattttatattcccattttcagaagagttggttagttactgaattcaacaaatgagtgtgagcaggggcctggagtacttaaaaagaataaacaaaatgcctttaaatcagaaacacaaaattgctagtaatttcagttaattgcactttactccatgtagctacaattgtagatatctagaaaaaatatctatgataaaagcctgccatctggaaaagtcaaaagaatgatgagctggtattaaatctcagtaaccctgacatatggaatatctctgccatgttaaaagcagaccttggtatgagactgactctgggctttacatatgaatttggaattgccaatatctctacttgaactatgtgagacaataaaagtgctcccttatacactttagataatgggccctttgggggatctgatgttcattcagcctttcccagaaaaatacaactataataaaatgttgtaatcagtttcagtttatttattgctgatcttttatttttgttttaatttaacatggcaatccactttctatagtcaaaagtgcaatttaaagaactctaacaacttcacaatctagaagaatgtctttggaaattttaggattcaaatctaaaacaaattttgagatttctttttcctagattgtactgatgttataagtgccttatgtaatacccagttcttccccatggagatttctcagtgaaagaaccacatcacatgttcacaagagcatcaagaataagagggtcaggtacctaggaagaaagattggctagcattctctctcccccatcaaatataaatggatttagcacagggattttgtttaattcactactgtcagcacctagaaaaatgcttgaaatttttaatatgacaatgcacaattcaagaggaaataataacattgtattagtctgttctcacactgctataaagacatgcctatgaagtggtaatatatgaagaaaagaggtttcattgagtcacagttccacaggctgtacaggaggcattgctggggaggcctcaggaaacttaaaatcatggccaaatgcaaaggggaaacaggcacatcttcacatgactggtaggaaagagagagcggggaggtgctatacacttttacaaccatcaggtctcttgagaactcactataatgagaatagcaatagcaagagggaagtctgctcccatgattcaatcacctcctccaacattgtggattacaattcgatatgagacttgggtggagacacagagccaaaccatatcaaacattagtatgtgaaagtagttattatgataaaacatattttaaccaacatacaattagttatacgatttttataatgttttcagtgttaaaatttttgaaaaaactgcagaaaaacaagtggaaatgaacaaaattacattgacagtagtaagttgtaatgtttaattctttgaatgtttcagtgggagctagaaattggtttgatatactttttagttcagttggaatacttaacacttctccactttgcctaatatatgctgcagcaataaattaattttccttctgagatttctagtaatttggggagtgcttatttgcaaagaattgaaaaaaaaagtgacacaaattgatatatcacgcaaactatgtggttttgtattttcaactaattgctgaagagcacttatacacaaaaaatatcagattcctcaaagaggagatatttaaggcaagcaaagaaatgtataggtcagtttccttcaaataattttatttcttactcttaaaaatcttttatttcagattcaggggctacatgtgcgggtttgttacatgggtgtattgcatggtgctaaggtttgggcttctattgattcccttacccaatactaaacatagtacctaattggtagtattcaaaccctgctgccttttctcccaccctatttttggagtccccggtgtctactgttcctatctatattttccagtgtttagctcccacttataagtgagaatatgcagcgtttgtttttctgtatctgccttaatttgcttaggaagtggtctccagctgcattcatgttgctgcaaaggacatgattttgttctttttacggctgtgcagtattccacagtatatatgtaccacattttctttatccagtccatcgttgatgggcacctaggttgattccatgtctttgccattgtgaatagtattttgataaacatatgagtgcaggtgtctttttggaagaataatttatttttctttgggtaactacctagtaatgggattgctgggtcaaatagtagttttatttttggttctctgagaaatcatcaaactgctttccacaggagccaaattaatttacattctctccaacagtttataagtattccctttctctacagccatgccaatatctgttgttttttgactttttaataatagccattctgactggtgttccttttgcccactttttaatgaggttatttgggttttctgttgatttgtttaagttctttataaattctggatatttgttttttgttgggtacacagtttacaaatatcaaatattttcaatgtagaaacttggatctttgatttttatgatgataaattgaggcatattgcaagaaaaacatttgaatcagaatatttaccaatattatcataatagtgaattacatttttacttgtccctacattttggtaataacaattaaattttgctaaataataattaagtgctggtccaagatggtggactgattattcttccaggggaccaatttcaatgacaataaatgagaaaatgatgtgaatcagtaacaatactaatttaagctaatttctatatttctatggtgtacatgttctttgaaacaacaagtatctatcgctgtaagaataagacatttggaaaatgtcttatatatgtgagatatgtcatatatatgtatgtaaataaaccataacctttctatggtatatgatgtgagctattttcaaatatgtgagttccaacttccctctgttaaggaacatttaactttgagtgattcatgtgacttctgagaccagctgtccccagcctctgagattcagataaaaacaagtatccttagctctagattaatccagtggcactgagcatctatggtgatgaaggatatgttttcggtagtcattttaccaaagatggtgctgtgaaaaccatcaaaatataaatcatggccttaaccatctatctgagaagacaagactaatacacttgaaacacaagaaacaaatgcaagataatatacatatatttgtcattgaattttgtaatacagcctacaaatgttatagaggctcatctaaatgaggaagtcaatgatgcatagtataatcaagatatgcttcctagaacacattgtgtagatggatttgaataggcagatggataaagatgaacatttaagacatgagcaaatgcctacacacctgaaaaaatgtggcaagtctgtataggagagaagaacatatctgagggcttgagctacggtgtgataaggagctcatttgaataatctggtggaatcagatgggctatggaagcctgatggagtaacacaagcagataatcaacaaagatgcttatcagctctaagaaggaatagaaaaaaatttcagaatataaaccatggaacatgtctcaaggaaataatttttatatgtataaaatttaacctaaatataattctataatgtaaacagaaaaaaataatggactggaaactattttcatcaaatatgaacattataaattactatcatgtgttactcaatgtactttaaattttagacattttaaaatgattcaatttttcaatttgtctttaaatttatatataatatatttgagatataaaaaaaccaaactgtttttcttagtctcacacactcaccactcaatacattacttcacctctggtcaccaaaatatgtatggatttttccccgcatgcaaagtaattctccagcagacaccactagggtggcctattattgaattcaattctgacactatctacttggatatagggtcagatcccacacagtaagggcacagtctcacaagacttcccttcacttcagatgccaactgcaggtcccaggatgtgacctgtacttctggccaactggctataaattggaggttcccattaccccctgtttaggttcaattaatctgctagaatggctcacagaactcagagaaaaacattatttacatttactcatttattacaaaggatattattaaggaaactaatgaacagttaggtggagaagctgcatagggcaagcttgtccaacctgccttattttgttgagattgttgttgttgtttttgttgctgtcctgttttgttttgctttagacttttagcaacctgaagccatggtttttagtttctgtctatagtgataagcagaaaagaggaagaaggaaggggctttactggcccaaccgggaacagaaactaagaactcatgactgtattccctcccttggacatcactgaaggtgtgagagaaggggtagggagcttccgtgccctctctggtatgccaccctcaggcacctccatgagttcagcaattcagaagctctccaaactgattttggggttttatgaaagcttcattatgtagaaatggttgattacatcattggccattggtaatcaactaaattttcagcccctttcctcttcctggggaataaggggttggggctaaaagttcttatcctctaattacatggttggttttcatagcaatcagctcctattctaaggctatccaggagcctaccaagagtcaactcattagagcaagagatgctcctataatccaggatattccagggatgtaggagctctgtatcagatactcctatcactcaggaaattaaaaagttcttcggagctctgtgtcaagaaccagggtcaaagaccaaatataagaacaaaagatactcctagcatccctatctggcaagggttttagaagctctgtctcaggaatcagggacagagaccaaatacataatttttattatatcacaatatcacatggcataattcacttttatattttgtatatagttcaataagttttaccaaatgcatgaagtaatgtagctaccactacaatcagtaacacagaatagtctcatcaccacaaaacaactctccctggaatcccctttgtaagcactctctactgatatgtaacctctagaaaccactgatctgttttctgctcctataatctggtgtacttcagagtctcagaaaaatgtgataataggaaatgaatgataaaaagctataaaacctacagaaaacaaatagcagagtgccaatagtaagttcttccctttaaatgtaaatagattaaactctgcagccaaaagatatagattggcagaatggatttttttaaaaaaatccacacaggatccaactctattctgtctataataaactcactttagccctaagtacaagcacaggttgatagtggaaatacggcaaaatatattctatgcaaatagtaataaaaagaaagaagggtgcctatactatcagccaaaatagactttaagtgaaaaactcttataagagacaaggaagggcattatatagtgataatagaatcagttcaccaagaagacataacagttttaaacatatatggaccaaacaccagagcttcaaaatatatgaaatattttcctaaatcagagtcatgggtattttctcctagattatcttgtaaagttttataattttacatttatgtctataatccatttttaattttttataaagagggagttataagtagaggtttatttttcacataagatgccaaattattccagcaccatttattaaaaagaaaattctatctgttctttgatctttatcaaagatcaattgaccatatatgtgggcatcagtttatggattctctattctgttacattgacctgcatgactatcttgattactgtaacttaacatcagatagtgtgattcctctaactttgtcattttcaaaattattttagaatttttgcccctttaccatgccctatacaatttaagaatcagtttgtgctttatcaggataagaaaattgcctttatttgtactttgctgagagttttcataatatgtggatattcaattttgtcaaatatttttatgtacctagttgtgtgactgttagattttatcaaagcattgtaagaaaattgctatgagtactgcagaggattagctcttcttgttattcccagatcagccctatattttgactggaatttttcatttcactaatatgtatctagaggactgtatattcttccctatttatttaagcaattatttatatacatttagaattaaaaataatttaatactttgagatataattcaatactactttgcttattttattgcacaaattgttctagttttggccactgggagttctttctgttggctcctgtattcctttgatatacccccatcattgagggtttttaaaatgtggtttattattaatgaaattaaaatgatctattcatagcacctgagatgatttcagatatcatattatgcaagcattaagataatattaagaattagtctggtaaatgaaaatcatagaatcagagtacttactcaatgtcaagttttgctaataattgcaatgacacaagcagttatatgacacaagtgaagcagaaagtgttctgggaccccaatgtgacttattgggtcatttcttctcacatgagatgtgttctggtacagatcttgcacagaagaagccacttaggtcatgaattactgagttacatagtttatgtgacattttccttggagccatcccctgtaaacctaaagattccaggtctgtttaccacaggtgattctagataggcagctatattttactatatgtatttcatagttctctcttgctagccaaggtcacatactttgtttgccaggagagctgccattataatgtttacaaggcaattagacaagataatatgctttctttcttcctttgatgcatcacccaaactctgccatgagagagaagggcatgcaggtctacttcataagtcctttctttctagatattctggtacagtattttaatgtattttatgatacagatactctagcatttaatatattttaatgtatcatgtttaatataagctcgataaagaatcatcacttcacatactttggataataattgtacacagtgcaaattcatggagaaaataatcagaaccattaatgctgataattttggggcatttaaacctttttcaggtcaatggattaatagatttattagctcttgcagaatgcaagcatattacagatttatagtataagtggttaaaaacatttttatttcactgaaaattcatgtaaagtgaagcctttgcaaaactgtaacctttatgcttttaataaaacagtatttctgttgtacatggtaatgattttgttctggaacactatgtataagcagattttgaattgaaggcagtggagcaagtctgtcaaaaatcaattcaattgatttccatttatgtagatgcattgagttttacagtggttgaagctctctttaaattgattggattcagaatgcaggccagtggtccgcatccatattctacaccttttttccaaaacttggtaaagaaaaatgctttagaaactttcctgaacaaataatataaagatcataccatctatatgttaaccaattagttatgaaatctaaaatcattaaggttacatttcaaaagtgaagttactaaaaaggtgaaattcaaatctaatagaaatagggtaaaatgcagaacatttatgaaacataaaagagggactatctgtgttagcaattaagggctgtagcaatttctgatatcagattccaaatttgaagagatccagacacttcatatacaggtttattttgccctaatattttgtcttattgagaattgtggtaaagagagaagacctgagtttcattcttataatggtttgagacatgaggaagtcactgaacatttctggacgtaactcacttgcatgatttcaactatcacatatacttggatgcttgaattacaaacctatgtagactagactttcctgctaagctgaaaagctgtatatgaacatttctttcatgttagctccagttgactgtttctcaggtactttcaatttcacatgtcccaaatttttctgattttcctctggcctctgaatgccctttctctgtgagcagcatcgtcacacaccttgtcacccaatctcaaaaatggaaagacaccttccaaatagcctcttctcaccacccttatcttattccacaccctgtttcaaacactgtgaaggtttttggggtagctgttcaaaggacctaccacaattagtttctgaaaagaacaaaaaaattactagctccagctggttgaccatcacaattgagatcatgcttgattctgcctctgatgtaagattttcattgctcaaggcagtcaataaattttgattcttaaagacacactctgataattttctgtgaagtaggaaactcactcaagaagaccagcctttgagtggtatcacagtctagactttaaatttataaggtggaaatgggctatagttggaatagattcttagctctgtggattctatttctatcacagctctcctatccacctccctctccattgcccatgaaatggcctaaatccaggcctttaacactttttatttgaattattatggaaatagttaactgtccttactgcctccagacatgcttccctctagcttcctccttcatattgatgtgcaatgatataaactccaaatctgatccaaatctgctgaaaagcctttaataaatgacttcctacattttttcaggaaaaagtttaagttttgtggctcatcacataccacattttttgaatgaatatacagtaaaataaaaagtagtagaaataccatttgacccagcaatcccattactgggtatatacccaaaggattataaatcatgctgctataaagacacacacacacacacacacgtatgtttattgcggcactattcacaatagcaaagacttggaaccaacccaatgtccaacaatgatagactggattaagaaaatgtggcacatatacaccatggaatactatgcagccataaaaaatgatgagttcatgtcctttgtagggacatggatgaagctggaaaccattgttctcagcaaactgttgcaaggacaaaaaaacaaacaccccatgttcttactcataggtgggaactgaacaatgaaaacacatggacacaggaaggggaccatcacacaccggggactgttgtggggttggggaatgggggagggatagcattaggagatatacctaatgctaaatgatgagttactgggtgcagcacaccaacatggcacatgtatacatatgtaacaaacctgcacgttgtgcacatgtaccctaaaacttaaagtataataataataaaagaaaaaaaagtagttgaatgaatatagagtaaacaaaaatgggtgggcctcatgcttctataaaatacaaggctttattaggtaaattaaaagtttcttaagcttccaacattttcttattccacaggaagctgtaaaattttctgcactggatccacactttgtctttatattctcctctcagcacaccatttcccaatatttggcaacccacaggttagcatcgaaaataaacaagtcagggtggctggcaaggtggccaaataggaacagctctggtctgcagctcccagtgagatcaacgcagaaggcagaaggtgggtgatttctgcatttccaactgaggtaaccagctcatctcattgggactggttagacagtgggtgcagcccaaggaaggtgagctgaagtagggtggggcatcacctcactcacgaagtgcaaggggttggggaactccctcccctagccaagggaagccatgagggactgtgccatgaggaatggtgcattacagcccacgtactatgcttttcccatggtcttcacaacctgcagaccaggagattctctcgggtgcctgcaccaccagggccctgggtttcaagcacaaaactgggtggccatttggacagacactgagctagctgcaggagttttttcataccccattggtgcctgagaatgccagcaaaacagaaccgttcactcccctggaaagggggctgaaaccagggagccaagtattctagctcagagtatcccaccccaacagagcccagcaagctaagatccactggcttgaaattttcactgccagcacagcagtctgaagttgatctgggatgcttgagcttggtggggggaaggctactcaagccatcactgaggtttgagtaggcggttttcccctcacagtgtaaacaaagctgccaggaagtttgaactgggtggagcccactgcagctcagcaaagccactgtagctagactgcctctctagattcctcttctctgggaagggcatctctgaaagaaaggcagcagccctagtcaggggcttatagataaaactcccatctccctgggacagagcacctgggggaaggggcagctgcaggcacagcttcagcagacttaaacgttcctatctgctggctctgaagagagcaatggatctcccagcacagcgctcaagctctgctaagggacacactgccttctcaagtgagtccctgacccctgcacatcctgactgggagacacctcccagcaggggtcgacagacacctcacacaggagagctctggttggcatctggtgggtgcccctctgggacaaagcttccagaggaaggaacaggcagcaatctttgctgtccggcagcctccgctggtgatacctgggcaaacagggtctggagtggacctccagcaaattccagcagattggatgttattggtttatagaaatgctactgaattttggacattgatattctatcctggaactttgttgaagttgtttatcagagctgggacccttttgtcagagactgggattttctaggtatagaatcatattatctgcaaacagagatagtttgacttcctcttttcctgtttggacaccttttatttccttctcttacctgattgctcttgctaggacttccagtactacaatggctaggagtgatgagagtgggtatccttgttttgttccagttctcaaggggaatgtttctggattttgcccattcagtatgatgctggctgtgagttgtcacggatggctcttattattttgagttatgtaccttcaatacttagtttgttgagggtttttaaacacgaaaagatgttgaatgttattgaaagacttttctatgatgatcatgtggtttttgtttttagttctgcttatgcaatgaatcaaatttatggatttatgtatgttgaaccaaccttatatcctaggaataacgcctacttgatttggtagattagcttttcgatgtgctgctggatttttgttgaggatttttgcatctatgtttatcagggatattggcctgaagttttctttttccattgtttctctggcaggttttggtatcagaataatgctggcctcatagaatgagtgagggctcagctcaggctctttgttcactccccagcttgcaggcagcaggggcagggaccttggcagtgacaatgttagagggcgttacacttacctcttggagctccaacccagagaaatgcagagcctctgctaaccaaaatgatcagcccggggtggagtggctacatcacacacccaagttgtaggccttgcctggtggtgagcagggggtgggggctcacagggaagacagtctggcctctttgggaaagagcaaagaacctgagtgcctgtggtgtgctggaggtgtaataaggcactcaagttctttgttctttcccaacctggtggcagcaatagcaggcaccgctgtagcagtggtgtcagagggatcgtcagttgcctctgagaactccaccccagagatacatgaagctactgccaatgggaatgatcagctgggggtggggtggctgcatggcaggcccaatccaggggccctgcctggtgtagagcagggggtcaggggttcacagggaaaagagactgggttcctctctgtatggcagctgcagcatgctggaggtaccagcaaaacagtcaggatctttgttctttccccagcccgagggcagcaagtgcaatatccctgcagctgagatggtagacagcctttgggtcgtctctgggatttcctctccagataaacgcagtgccaccactgactgaagtgctcaggcgggggcaggatgactgtgctggggtccaggttgggaggccctgcacaatgaggagtagcaggggcaggaatccacatgggaaatagtctggctgcttttctgtatggcagctgcactgcgttggagacatacgatagtccttaggctcatcacttactccctctgccgcctcagggcagtaggggtgggggctgcagcagcagcaaaaaggcagaactgtcagttaactctgggagctctggcccagggaagtgcagagtcgctactagcctaagtattcaggcaggggtgtgttggctgcgctggggacctgggccggtgggctttggctggcaaggtgtggcgaaggtaaggcctatagtctgtctgctcctcagcactgtgaaagcagcatgtatcttgggagcatgcaagagggcttggcctcacctgctggcagagctatggcagctgaccctgggatgctcaggagcccaaggcccttgaggctccatatgtgcctgagtggcagctctgcccagactccgcacagcgctctgtcagtctggaggccctggagagagagggtcaggggatctcctgtgcccaggattgcagagatgcatggcaagagtatgggctcctgggggctcttgctcactcaccctttccctgtggtgagaagccttccttggctccatgccaatcccaggtgggcagctgtcctgtctcactcttctctcttctctcggggttttgttgcttccttgatgagtcccaacgtgtcctcctgggcaatccagttgaagaggtagtgtttattggccattctgtccctttatattatgcaacccatctgagccatagtccttcagccacatccatgaccaagtgcctgggagatttaaataaactcggtgctccgcttgtgtagtaaaaacagactaccacctaagctgagatttttaatcatcacttatggaaaggatatccatgaaagtccattaaaactatgaatatatacagattgaatatctgataagacacatcttgaaaatacgtaaatattttgatgcataatgtttaaggaaggagaaaagaacagagacctttttttaaccttttcgtcctatgtgatatctgtatttagaatacagttaactcatctgcaaatccgattctaaataacagagaaaaaaatctatgttaatttttccccatttcacttgtattatttggggatatgtaatttctaaaaggcaataggcaatacaatgatattttaatttttaaaaacaagcagttttttttttttttttttttttttttgcttttctcacttggaatgccaatcaacaagggttttttggttttttggttttttgcttgtttgtttactccacttataatgaaatcaagtagtttttctgaacagaataatatattcaggggaagaaatagcttataagattattgactgaatgtgaagctcaaacattaaatgagatgaaaaaactaaattagttattccctgagacaaacagggatgggagaatacctctgggaggcagctccttttcctcagttttacttatgtatttagttcaacatatccacacatagtgcttatcatataccaggtactattgtaaaatacgtaactgttgatttactggattctcataactccctgggaaggttattattatcattttgcccttttacctgaggcaagtgaggctcatacacggtgtgatggttgattttatgcatttacttgactgggcatggggtgcacagacatttgatcaaacattcttctgggtacttccatgagggtgttttctgatgagattaacattgcaatcagtagactagttaaagaaagcagattgtccttcttaatgtgagtggccctcatctaatcaccagaaagtctgttaagtagaacaaaaaggctgattcttgagcaaataagaaagaactgctcctgcctggcggtttcagcttggacattggtgtcttctgtcttcagactcagctgaaacattggctcctcagactcacactggaactacaccattggctctcccaagtctctagcttgtcagttgcacatcttgggacttctcagcctccataattacatgagccaattccttatcataaattttattatatatatgcatgtgtacacacacacacacatgcacacatatgcacacacgcacgcacacgtgcatgcacacacacacacgcactcacacatacacacacaatctgtttatccagaggactctaatacagggagtaagtgtctcaaggccacatagttacaaagctcacccagggagtctgactccagggcccatgctctgggcatcaaatatcactcaatgttcacataaaacataatgtcttaggcacattacatgtacagtaagtcataacttaatgtcattgataggttatttgaaattgcaactttaagtgaaaagacatactgtatgccataggaacttaactcttatatcaattagcatatggtaaaattggttttgttatatagtacaatattttacttaaagttgcagtttcttttttttttttttttttttgagacagagtctccctctgttgccccggctggagtgcagtggcgcgatctgggctcactgcaagctccgcctcctgggttcacaccattctcctgcctccgcctcctaagtagctgggaccacaggagcccgccaccacgcccagctaatttattttttttgttgtatttttttttttagtagagactgggtttcaccatgttagacagaatggtcttaatctcctgacctcgtgatccacccgccttggcctctcaaagtgctaggattacaggcatgagccaccatgcccagcctaaagttgcagtttctaagaacctgtcaatgccattaagtgaagacttactgtactcctgtgagatcaatactaatatctcaatttgagaaatgaaaaatttgagtctcagatgatttaagcaaaatacccaaggttacatagttctatgtagctgaggtagaacttgaacccagatctttgtggctccaaacaccattttctttccaatttgccttctgtcagttatctacctttaattaatataagtatttatctacctttaattaattactatacataatcatgaaataagctgaattatctctgcattttaagatctagataaaatgggtttattaccacactggtggaaaatcccagtagccctcctgcatttatgtgaatttcagattccctgactctgaattgacaagttctctaaactcttttttctctttgcagcatctagaaacttcttacttccacatgaggaatgcaatgtcatttgttggattttcacatgacaacaaaagaaaataataaacaagaccttgcttgcatggaaaattcattgcctattgtaggaaaagtcagggatgtcattacacagagcaaagaaaataacagaggttaatcaatgttactgctagcttgctcttatatatacttattttcatttctgatgcttttttcctctcaagggtaaaaaaacaaacatcaaacctctataaatctctcatgcagggcacccagctttctgcagctctgtccttctttggtttgtaatccacacttttgaagcccttctaagtgcattcatagacaaggccatctctccccttggcctctgactgtggggcagggggtaaaaagtgggaggtgggttatatgcttctagttgggtaaatgctaagcgtttttatgtgggttgcattttatttttgctttctaacaaacataattgaacattcagaaagggtaagtaactttccaaaagtttcacagatactgaaagataagtcagggttcatactttggtctgtctgatcacaagccagactaagatttgaacttctatgagactgtttcctcaaatttaaaatcagaatcatgttatctaattcactggctgaaccaagctcattcctcacccattttttattggtacttcttaaagaatgtggtcctcactctctagattccatgttttgagcgtaaaattcctatccctgtaccccaggcagagaggactggaccaggcgtggacctctgacctacaagatccaaggcattatgtttgccttgttcatcacctccttcaattgtagatgctgcagatgctgccctctctgtagaggtttaagtaaacaggaaagaatgtttaatgaaaataaggggaacaaagaaaccatgtggagtaaaagcagagatgacacatcaggaggccacaaatgaacaataagtgaaacattagttcctggacctcaaaccttcatgccagcattcaggaggcttcctaggcaaggaagtaaattggtgtgaggtgactgaactgcaagatgaggtggaatttcaacattcagactgccctctctgcagaggtttaagtaaacaggaaagaatgcttaatgaaaataaggggaacaaagaaactatgtggagtaaaagcagagatgacacatcaggaggccacaaatgaacaataagtgaaacattagttcctggacctcaaaccttcatgccagcattcaggaggcttcctaggcaaggcctgtcagctgtcctatttcttccactagatctctttcttttgttttgtttaagctagtttcaatgacaggcaactatctcttgtaatgaaatgatcctaagataaagggttattgtaaagttcaaatgtaattagataaggaaatgtgcgtacatgtggttagcacatatctagaaaatgatggttattaaagagtaactgtttggttacaattatctcaatcttagcactattaaaatttcccggaggtcagcctgcttttttcaggacaaggattataatattccacgagattcaaattagtcatatatttttaatttgaaaagaaaactacaaaagatgttataattcaatgtaagcacactttatagcaaatttattgtttgatttcattttcatgctatattaaaattttttgtatcagtgcttgtccaacatggtacaatggaaacaatcacattggaataatcaaatttttgaattacttataatatgctctttcattttaccagattttttgaaacaaaaaatgaatattgaagaatattcatagtatctatagctattttctgttcagtttctgaaagaatgaggaatagtagcttttcaaaagttggattttggtttttgtttaattataatatcattcaaaggactaataaagactaaaaggaacaatgactttattgtaaagatacatatagactgactcttcaaagtcaccatgaggaaggctgcactgtggctatttaaatgtaaatatatttaaatcaaacaaaactaaaaatatagttttttagttacatgagccacatttcaagcgctcaatatgttgctaccatattgcataggtatggaagatttccttcaccgcaggaagttctgtaaagcactagctttctccacatctttctttctttattaggcattgttttccataaaattttctacctgctatgaccactcaaagctctacttccatctcacccatgggcaaaatatgcgctacagtggccatttacctttttgttaaagtcacagaaagaatgtagtaacactcttattttttttaatccaacaacctcttttaattgtgaaactgctgcctctgactacaagcatgagcaattgaccaggtctaatctcatcaaccatggctccttatattccttactctagttgtgagtccaagggtaggcatggaatcgtattaggatcatagatcctctatgagattataatattccaatattggggcaagataggtctctcttgcttttacttggaacaagtgatcgatggagatggcagaggccatcttggcaccatagggaaaaggcctgcttgagaatgaagctaagcaaatgcaaacagtgctgagagatgtggcattgttcctaaatctcaacgtgtgaaaaaaccaattcctttagcttgaatgtggttacagctgtttgcaaacaaaatatttctgaggctgaggagggaggattgcttgagcccaggagtttgagatcagtctgggcaatgtagcaagaccctgtttccatgaaaaaaaaattacctgggcctggttgtgtgtgcctgtagtcccagctacttgggaggctggggtaggaggatctctcaagcccaggaagtcaaggctgcagtgagccatgatgacactgctgcactccagcctacgcaacagagtgagaccatttcaaaaaaaagtctggttaatatatgggtatttgtgcattttatggcattgtgtattaaaagatacatatttacaatactacattatttaactctctaagtagatttctatatagtataatactgccattatgttttgtctttgacattgcatattgtcaattttattcagtttatttagtgcatactttatgtaaggtactctcatattcgacaaaaattcttctaataaaataaatggacaaatcaagaatgtatcaaagaatatgagttctgtcttgatcattggtacagtttggatatttgtgccctccaaatctcatgttgaaatgtgatccccagtgttggaagtggggcctggtgggaggtgtttgcgtcataggggtgggttcctcatgaaaagcctggtgtcctccctgtggtaatgagtgggctcaggttctattagtttacaggaggtctgattggtaaaaagagtctggcacttcgttccctctctcgccatgtgagaggccaactcccccttcaccatctgccatgattgtaagcttcctgaggcctcaccagaagcagatgctgatgccatgctttttgtacagtctgcagaactgtgagccaaaataaatctcttttccctataaaccactcagcctcagccaaccgcggtggctcacgcctgtaatcccagcacttcaggaggccaagatgggtggatcacgaggtcaggagatcgagaccatcctggctaacatggtgaaaccccgtctctactaaaaatacaaaaaaaaattagcctatcgtggtggcgggcgcctgtactcccagctactcgggaggctgaggcaggagaatggcgtgaacccgggaggcggagcttgaagtgagccgagatcgcgccactgcactccagcctgggcgacagagcgagactccgtctcaaaaaaaaaaaaaaaaaaaatcactcagcctcaggtattcctttatagcaacgcaaaatttactaatacaatcacaattactttttaaatgcaaactagctgggaaagttgtctgtctcaaatatttaagactataattttatgatcatacaactcatactcccagcactcagtaaagacaacttatatttctgtcagtctttcatatgcacaattagaaaatgattaaaatagtctgataatagatttccctgttaagttcagaagcccagtattctttcttggtttttaactggcatgctacttttaattttatatttatttctgttaatgatgaatatagaggcaataaatactacttttctttatataggattggattacaattaactgatgaatttaggaaaggacttaaagatttatttttatcatcttgtaatttaaaacaaaacaacagggctataaactccaactatgcaagtaaatgtaaagctcaacttcaaaaaataaatgacttgacaatgatgaaaaagtagaaaatgtttgagaaactttatagaaatatccttttacttcaaaaacaggagaaatgtgtactacaggtaggcccctacttacagactcctaattattcatatgtgaattctcagaaggcaagggctgggggtaatactgcttttaatgaaaatctgcttttatgagttttcagatgccataaccaaactgacattgtgtaccgttgttctctggggagcttcatgcgcagaatgaactcatatgttacatgaccttgggtcaaacaatatcttaaagaagtaatcagtataacatttcagaaattgaggtggccaaagtcggtccaggaaagtctctcaggatttgatatgctgagtgcaggagaattcattttccattcagagaaaaggtcgtacaaagtattcatgtgcctcaagtgctgaaagcaatatagaagaagaaaaattgggcttaaacaaaattttaaaaaatctgtcttcattttctcccccatgatcctttatatctaggaaggctattactgtggagaggccttaatatggactatttagaccagtcatttgaataaacgtcctaacaacagcagaaaaacatgatcagtgttctgcagaatctggacttgtaatcaagtagtcagtgtttaagagacaagtttaggtcatggaaatatactggagccaaaaatcagaattctagtttttgctccagcactgatttgttcagctatgagtgacgttttcagatagatttctttagggtaggaagcaataatgttatatgacttggaaaggcttgatgaatgttactgagtaaatagatgtttgctgattgctgttgaacagtggatcaaattattaaagaaaagttaggatagaaaaatccaaatacaggcggggtgcggtggctcacgcctataatctcagcactttgggaggccgaggcgggcggatcacgaggtcaggagatctagaccatcctggctaacacggtgaaaccccgtctctactaaaaatacaaaaaattagccgggcgtggtggcaggcacctgtagtcccagctactcgggaggctgaggcaggagaatggcgtgaacccaggaggcggagcttgcagtgagctgagattgcgccactgcactccagcctgggagactgagcaagactcggtttccaaaaaaaaaaaaaaaaaagaaagaaagaaaagaaaaatctaaatacaaaattataacagtatgtagccatttagagtccattagttacaaagctgttaagattatagatactgcatattataatatatacgtgtggaatttctggaactgatattgtttttgtttaggcagttgccagtttggcaacattttacattttctgtagtgagtgaaaacaaattatttgatctgtaattactattttatgaaacatattatttgactgttaaatcatcaattcttttggagctggccaacaatgtaccaatttatttttagtagtgcagcccatgataaagaaaagcagaaagccactaaggacaaaaagattactgagagctcctcctcattgtacttaaattttgtttaggatgagataaatggaaaaagagcttcagactttgaagatctagaaatttgggcaaattttccaaatgttcgtgtggatgagtaaactgtcacatttccagaacgaagaacattgttttttattctgcatggagtagtattagggaaaatgttcaattgaaaaagttaccatataagaattatatccagagtatcatatttaattgattttttgcttacgcaaaaaaaaaaattcaattatcaatgtttttgagcaaaaataaggcaacaggtcaggctctaaaaataaatataagactataaaagatgcatgtcttatattctaccatggtaaatggggcagtggtaaaggagaatgcagagtcctccttctggtatacagaatttatattattgctttattattgcctcacacacatcaacccttgaggcagaaaagatgtgttcatagaaagcaacttaccagtgaccgtgccagacatgttcaaatatgcttcactatttgaagcatggtaagaatacactaatattaatgtaacatcgacaggaattcagtaaagatagaaatctgacaatagtaacaaccatcattaattaatgagtccttgttatataccaggcactgtgttagtgctctctgtctttctgtctgtctctctctctcagaaactatgcatattcatatatatttatataaaatgatcatacaattccagcagccacataaaagtttggaagcgtttccccttttttctctttttgaagaaatggggaaacacaggcacagacaaatatggaaactttgcagcattcatgcagaggatgcagaatggagcctgaattaaaatgctccctcagatagaagaggctttctttctagaaagactgtgtggtgaaggtcctggattgtgacaaatatgctatttcctctaaacccagactccctcctcttcaggtggtttgaaccatctttcctacccctaaacctgtagattatgcctccatctctcccatccttacactccactcaaaaggtaagctgctctcttcgttctttctcttagtccattctgcctccaaatgtctccaccatactctctctggaacaccattccattctcatcaactccctccacatcctctaccttacacaccttgacttaagtgagccttctataaagacactgcccacctcccacctccagcaattgcaaagggatgcttctcagagttggaggcttcttggggttgggaggagaggccagtgttctccaccctcagtgcagttccagaccattcctcctatgaaacaaaccctttcccttgaggctgacaacatccagccatgtgaccctgtacttctttctcacactcttttgcttttactgaagactttgaagctttttctctaagtttcaccatcatttttgtatctggcacatagtagttgctaaattatattattaaaaaattcacagtgattattcttaataaattatgtgtgatacactcacaattcatggtgaaatgaccatgtatctcgagaagagagttgaaaaggacaatgaggacaccccttcccatactccaaactctaagttgcatgatcttgtcagtctcaggattgtcagccatccactcccacagccaaatcctagacatgctggagcttcgaaatattcgattataatatcacatacatacacacttattccaaactgcattcctccagccatcactcatcacctccactctgcctttcttcattgtattgtaaagaatgaattgggttagtgtgacagtctttatcagtattcccattactctactactttgtcttcctactgtacctcctgtggaaaaaaattccacatcatcatccaccagaccgtcttctgttctcctcctacacaaacaactctcctacagatgaagaaactcatataactgcattaaaagttcatttgaaaggcatagttgccaaactcagttggaataccacctggtatttctatattttcctgggcaactttctctttcacttcccacagagcatatttcaaacttctattgtgctttagttttctttattacatcaccatatgaaagtgtaattcatttattctgcacttacttactagacatctgttatgtgtcaggcaaagggtgctgggtattatggtagaaaaaagtataacatttgagtttgttccctctcacttctgcctttgttcctaaaagtattcacctatctctgtgcccaccttgcctaggggaagatatatctccctccatgcccaaccattctacctgtactctgttagctcagccattacctcagttagcttatccctctctcctctacctgaaaattctccatcctactggctcactgccccagcagcacttacacttatttatttctgtcctatctttaaccaatcaatatgaccactctcaaccattatgtttgcttctaagtatttccctatatcttctacattcttcagacccgcggtacagttgaccacgctcccctcctcgttcatttcattctctctccagcctcctgcagtttggcatcttcactattctaccgcagcagtcccttccagggtcaacaaagcctctttattagaaaatgcacagggcatttactttcttcagtctttgaactctgcaggcattttgtgtgtgtgtgtgtgtgggtggagacagaattttgctcttgctgcccaaggctggagtgtcatggcacaatctctgctcactgcaacctccacctcccgggttcaagtgattctcctgcctcaccctcccaagtagctgggattacaggtgcctgccataatgcctggctaatttttgcattattagcagagacagggtttcaccatgttggccaggctggtctagaacccctgacttcagatgatctactcgcctcagcctcccaacgtgctgggattacaggagtaagccactgtgcctggccaggcatttctttttataaacggtgtaccctgcctctgggccaccagaggttcctggtcttcttccactcacctctatgttcggttactctgcctgtcatgacatgcggtgatcctctatgttcattcttctctccttacagtttgtgtgttccatgaatgacattatttactccctcaaatccaagtgcatattttatttgtgtgaatccccaataagtaagttcctatggacagaggctgtgcatgttcgttgttttagtcctgacacctatcacagctgcctgacaacccagtgcccagcaacacagaaaaatgcacagactgaataatacaggaaattgtaggctgggcgcggtggctcaggcctataatcccagccctttgggaggccgaggtgggtggatcacgaggtcaggagatcgagaccacgatgaaaccacgtctctactaaaaatgcaaaaaaattagccgggcgcggtggcgggcgcctatagtcccagctacttgggaggctgaggcaggagaatggcgtgaacccgggaggcggagcttgctgtgagccaagatcgtgtcactgcactccagcctgggcgacagagcgagactgtgtctcaaaaaaaaaaaaaaaaatacaggaagttgtaaccaggaggacccactgaaagtggagtgtattctttcactcagtattcactgggaatgcactatacactagttccaatgcttgtgttgggaattcagtgaagagcaagaaagacaaagtagcccctggcacttacattctagtaagggaaatagtcattaaacatatgtactatacagggagtcagagagtgacaagtgccacgaagaaaataaagcagggaagggagttacagagtgatagaaggtaaaagtgcgccagctagttagggtagtctgggaaggaaggctttttggtggcattaaccctgaagaaatgaatgtaatgagaaaatgcctagcggctatttgaaagaaaaccatttcaaaaggaggaaatggtaagtacggtgaagtgggaaaggctttggggtacttgaggagcagaaatcaggccaaagggattggagctgaagttctgattctaggtagaatataggaggcagtggcactgcatcactcccactgcaacaagtagttcaaaaagtaaagaaattggaaatgtaatcgttttaaagatatccgagagctgtggtggcatagatgattagatggactacaagtgaagttgagatgactcctatttccttcactgagaggcaaggtttctgttcagacttgccctaagctgaggtgtttcgccaggggaaagagaagacaatagagcttactttctacgtagcttcattgaggtatgactcatgcaccgtacaattcacccatataaaatttacaattcaatattttttagtgttttagagatatgtgcaaccatccccacagtcaacttttgaacatttttatcacctcagaaataaaagccatggccgggcgcagtggctcacgcctgtaatcccagcactttgggaggccaaggcggacagatcacgaggtcaggagtttgagatcagcctggccaatatggtgaaaccccgtctctactaaaaatacaaaaattatccaggcattgtggcacacacctgtagtcccagctacttgggaggctgaggtaggagaattgcttgaaccctgcactccagcctgggtgacagggcaagactccatcttaagaaaaaaaaagaaagaaaaaaaaggcacatgcttcagctattactccttgtcttcctaagcagcaactaggcttctttctcccagtagattgtcctattgtggacatttcatatgagtggagtcaataatatgtggtcttttgttactgacttctttcagttaacataatgttttcagggttctccatgttgtggcatgtatcagctcctcattccttttttgtgagtaaacaaaaaataacaaaatttaacattttaaccattttcaagtgtacagtactgttaactgtatgcaagttgttgtgcaataggcctctgtaactttttcatcttgccaaagggaaactctgtacccgtggaaaaactccccatttccccctcttccctagctctggttgtcacattctactttctgtttctatgaatttgattactttagaaaacgtatacacagggaatcatgcagcattattccttttatgactggcatatttcatgtagcataatgtgctcaagccttatccgtgttgtagcatacggtaagattttcttctttctttaggctgaataatattccagtgaatatatggtttatacattaatgatttgtcaggagatattagtgttcttccaactcttggctattgtgagtaatactgcaataaagatggatgtgcaaatatcttttcaaaatcctactttaaatttttttgatatatacccagaagtgggattgctggactatatggtagttctgttttaaattttttgaagaacctctgttttccatagtggctacaccattttacgttgccaccaacagtgcacaggggtttcaagttctctatatccttgccagtatttcttattttctgtttctgttttgtctttttggatagtgatctagctaagagatgtgaggtgacatctcattgtggttttgatttgcatttctctgattagtgatattgaacatatttttatatgttggccatattgatgtcatccttaaagaaacgtctattcaaatactttgttaatagggttttttgtttgtttgtttgtttgtctagttttgatgttgttgagttgtaggaattctctatatgtttggatattaaccctcatcggatacatggtttacaaatattttcttctgttctgtacgttgccttttcactctcttcattatttcctttctgtgaagaagatctgaagtttgatttagttccatttgtatatttttgcttttatttcctctgcctttggtgtcatgtccaagaaatcattgccaaatccaaaaacatgaagcttctcccctatatttttatcttactaggtaattttataattttataaattttagttttataaatataattttataaattacagttctataattttaggtcttacatttaggtcattaatccattttggtttgtttgttgttttgagacagggtctctctctgacaaccaggctggagtgcagtggcatcatcacagctgactgcagcctcaaccttctgggctcaagcaatcctcctgccttacccccacctctcccagtaggtggcactacagggtgcgcgccaccacacccgggggaatttttacattttttgtagagacgggtttgcagtgttgtccaggacttgagcgatcctcccacctcagcctcccaaagtggtgggattacaggcgtgagccactgcacctagccgttaattcattctgaagtgatttttatatataggtacaggaaggtaagggtctaacttcattattttacatgtgaatatcaagttttctcagcaccatttgttgaagacactatcttttccccattgtatagtcttgatgcccttatggcagattattttaccatatgtgtgagactttatttctgggctctctattctggcccattggtctatatgtgtgtctttattccagtattatgctattttgattactgtagctttacactgttttttgaacttgagaagtgtgagacctccagatttgtttttctttctcataactgtcttgactatttggaatactttgagattcctaatggattttggattttttttctgcttctgcaaaaaattccaatgagatttttatatggactgcattgaatctgtagatttgggggttagtatgaacactgtaaccatattcttttccaatccaggaacatgggatgtctttatatttattcgtgtcttcattaattactttcagcaatattaagagtattcagtatacaggtcttttgcctctttggttgggtttattcctaagtattttattctttttgatgctcttgtaaaggggatttaaaaacatttccttttctgattatttattcttagtgtctagaaatgcaactgatttttgtgggttgattttgtttcctgcaactttactgaattagtttattagttgtaacagttgtctgtgtgtgtgtgtgtgtgtgtgtgtgtgtaatccttcaggttttctacatgtaagattatatcatctgcaaacagagataattttatttcttcctttcaaaattgaatgctttttactcctttttcttgtctaattgctctgactagaactttcagtactgtgttgaatagacgtgacaagactgggcatgcttgccttgtttctatttgtagagggaaagcttgagtatgatggtagctatgggcattacctatagggcttttaatatgttgatgtaattttcttttatttctatattattgaattttacatgaaagggtgctgaattttattaaatgcttattattgcactaattgagatgatcatgtgacttttttacctttctgtcagttaatatagtgtattgcattgactaatttttgtatgttgaaccatccttgcatcccaggaataaataccacttggtcatagtgtactgctgaattaagtttatgatattttgttgaggatttttgcatcaatatttagcaagattattggtgtgtagtctttttgtggtgtccttctttagcattcgtattaaggtaatactggcctcataaaatgagtttgaaagtattttttcttctgaaatttttcagaagagtttgagaaagagtgatgctaactattctttaaatgtttggtaaaactcatcagtgaaaccatctagtcctggggcttttcttcattgggagatttttgattactaattaaatctcctaagttatagatgtgttcagattttaatttattcacaattcagtcttggtaggtagtatatttctaagaatttatttcttctaagttatccaatgtactggagtattgttcatagtagtctctcataatctttttacttctgcgtcctcatttttaatgtctcatttctgatttgtgttactttagacttctattttcttacttattgaaagaatttgttaatttttttatttttttaaaaaactcttatttcattgatttttctatttttttaatttattctctatttcatttatgttttctgtaatctatgaccttccttttgctaactgtaatctaggaccttccttttactaactttggatttagtttgctattctttttctagttctttgagatacaaaattatctccaattattgattggggatcttcttttaaaaatacaaacatttactgccacagttttggtgtgttgtgttttcattttcatctgctttaaaatactgttaaatagtgatttcttgactcatcaaattgttcaagagtatattgcttaatttccatatctttgtgaattttctggttcagcgttttctagtccagatttctagtttcatggtgattagaaaatatagttggttttctttcagttttttttttgaattgttaaaacttgttttgtgtcctaatatgtgttctgtcttggagactgttttatgtgcacctgagaagaatgtgtatattaacatagggtggaatattgtttatatatctattagattcaattcacttttagtattgttcaagtcctttatttccttattatttttctttccggttgatctatttattattgaaagaagagtattgtaatctcctcctattattttttttaatctaattcttcctccagttctatcaatgtttgcttcatgtatttgggtgctctgctgtttggtgcatatagacttataagtgttgtactgtgaattgacactttcatcaatacgatgtgtattgtttttctcttgtgacagtttttagcttaatgtctattttgtctgatatatgtatgggcacccttgctattttggttacctcttgcatggaatatatttttcgattccttcattttcagcctgtgtgtgttttcaaagctaagtgaatctcttgtagatagcatgcaattggatcttttaaaaattgattctgccactcggtcttttgactgcggagtttaatccattcactcttaaagtagttattgatggggaaggacttactattgcaattttgttaattgttttcagtatgtcttagagttgtttgtccctcttttcctctcttgctgcctttgtgtttcattgattttttttgtagtgatatgctttgaggactttcttattttctttggtatgtcttctatagcaattttccctgtaagttaccatggggattatataaaacatcttatagctataacaatttatttaaactaaaaatttaattcaattgcatacaaaacctctactcttttacctccaattcaccttacattatcaatgtcacaaattatacttttagtattttgtatccattaatataatttaataattatggttatttttatgcttttatttatacctgatttaaaaatgatttatggaccactattgtagtatgacaagattctgcattttttttttttttttagacagagtctcactctatcacccaggctggagtgcagtggtgcaatttcagctcgctgcaagttttgcctcctgggttcacgccattctcctgcctcagcctcctgagtagctgggactacaggcgcccgccaccatgccctgccacttttattttattttttatatttttagtagagacggggtttcaccgtgttggccaggatggtctcaatctcctgacctcgtgatctgcccacctcagcctcccaaagttctgggattacacgcttgagccactacgcctggcctagattctgcatttgactatatgtttacctttaccagagagccttatacttttgtatgctttcaagttggtatctagctttcttttatttcaactgaaaggactaccattagtaattctagcaaggtaggttaatggtgacgaacttcttcagcttttgtttatctgggaagatctttatttctccttcatttttgaaggggagatttgctgtctattcttagttggcagttttctttctctttcagccctttgaatatactaccccattccctttcagtatggaatgttcctgctgatgagtttgctgataatcttatgagagttctcttgtatataagtcacctttctcttgctgctttcaagattgtctgtcttggacttttgactgattataatgtgtcatggtgttggatctttaggttcatcttagacagagtccttcaagctgctgaaatttggttgtccatttcctttttcagatttgggaagttttcagccatttcttcaataagctctctgccacaggctactcttcgttgtgcaatctgtggacccagttgtcatctgccaccactgtctagttatcttttgactgccacaagtggactccaaaaaatctccaaaagaaattgttaccataacaagatggccaactagacacagccagaaagcactgctcccactgacagaaaccaaaatattgagtaaaccaacgtattttgagcccatcttcagagagaaaatgctgagagtcattacagacatgatgcagacaacaaggctgaagagggaggaagctgggaaccctgcacaggatacttgcatgacagggctagttcccagacctgaatgcctcctggggaagagataagtgaagggatggagggacaggccactctcactgtggacctctgggatcctaggtacatagaacttcacattctccatggccttttgagctggcaggggaatcttcaaagagagtaggcagagacagggcttcactggcatggagcctaggagcttttgtgtatgtggcagctgtggcagagcatggcctagacacccatcccccagggctccccacctccctacaggcagctctagcctcagctgattgctggcccaggagagagtgtggctggcttccctgtgggactgggaaacttccagggcccctgcctggccaccctgcaggaggtgtgcacagagtagcctctgctgccaagcctgggtgctttgcttcacctgagtaccttcctggtggcctgggagcactttggatcccccagaacagctggggcccaatctcaagggtctggaggatgaagctgaaagccagtcctggctccccaaaactacacaaatacatggaaattgaacagcttgttccagagtaactcctcggtgaacaataaaattaaggaagaaataaaaaaattctttgaaataaatgaaaatagggacacagctgaccaaaatctctgggacacagctagaacagtattaagaggaaagtttatagcactaagcaccttcagcaagaaattagaaaggtctcaaattaacaatgtacctttgcaactagaggaactagaaaaaaaaaagccaaccccaaagcaagcagaagataataaatatctaaaattagagaagaactgaatgaaatttagacacaaaaatccatagaaaagatcaatgaaacaaagtgttttttcttcagaagaataaacgatcaataaaccactagctatattaacaaagaaaaaaagagaaggtctaaataagtacaatcagaaatgacaaagaagacattgcaactgatcccacaaaaatacaaaagagcctcagagactattatgaacagctctatgtacacaaattaagaaaacctagagaaaatggataaattcctggaaacacacaaactcccaatattgaaccagaaagaaaatgaaaacttgaacagaccaataagttccaaaattatatcagtattaaagaaactgccaaccacaaaagaaaaaaaagaaaaagaaaaagaaaagccctggaccagatggattcacagacaaattctctcagacataaaaagaagaactggtaccagtcatattgaaactattcaaaaaaattgaaaaggaagggtacctctctaacttaccctacgaagccagaatcagtctgataccaaaatctggcagagacacaacaaaaaaagaaaacttcaggccaatatacctaacgaacataggtgcaaaaattctcaacaaaatactaggaaactgaatccagcagcacatcaaaaagttaatttaccacaataaggcaggctttactcctgggatgcaaggctggttgaacatatgcaaatcaataaatgtgatccaccagagtaacagaattaaaagcaaaacccatatgatcatctcagtagatgcaaaaagagctttcaataaaatccaacatcccttcatgataaaagccctcaacaaactaggcatctaaggttcatacctcaaaataataagagccacctacaccaaacccacagccaacatcatactgactgggcaaaagccagaagcattccccctaagaacaaaaacaagacaatgatgcctactctcactgctgctattcaatgtagtactaacagtcctagccagagcaattaggcaagaggaagaaataaaagacatccgcggctgggtgtggtggctcacgcctgtaatcccagcactttgggaggccgaggtgggcagatcacgaggtcaggagatcgagaccatcctggctaacacagtgaaaccccgtctctactaaaaatacaaaaacaaaaacaaaaaacaaacaaacaaacaaaaaagacatccgcatgggaaaagaagaggtcaaattatctctcttcactgacagtgtgattctctctttttttgaaactgagtctccctctgttgcccaggctggagtgcagtggcaccatctcagctcactgcagcctctgcctcctgggttcaagtgattcacctgccttagcctccagagtagctaggattacaggtattcaccaccacgcccagctaatttttgtattttttagtagagatggggtttcaccatgttggccaggctggtcttgaactcctgacctcaagtgatctgcctgcctcagcctcccaaagtgctgagattacaggtgtaagccaccatgcttggccactgataatatgattctatatctagaaaaccctaaagactctgccaaaaggcccgtcaaactgctaaatgacttcagtaatgtttcagggtacaaaaataatgtacaaaaatcaatagcatttctatatataactgagtacctcagcctcgaaatacatttttaaactatttttttcctttccttcctaatctcagaatgtagccttatagtgtaagactctttgttatgccctttcccaacaggcatatctgtgcacagtgcttgctcatctaactatgtgcttgcttagaaattccaggagccaattttgaaacaaaccaggcagagataccaggccgcagatcttcccactcaaggggagttacgcccaagtcaggatgatgcaaatcagatctctagatgggcgattacttgagataactatgggaacaagacatgcagctatgcactcccttttcactactcatgtctatatcccacacctttttccttcttaaacccgttcactcagcccagaaggctgagatggctcttttgaggcttatgcccagacattctcccatctgctagaatttgaccaataaaagttgctttcctttcaccacacgtcagttcttatgctttgacttctgagagaagagcagctggacttgagctggttacatatacaccaataatgttcaagctgagagccaaatcaagaacacaatcccatttacaatagccacacacaaaaatgaaatacctaggaatacagctaaccaagaaagttaaagatctctacaaacctgacaatgttggtgttgtcgtgtttggaaatgattaactaattaaggaaggaactagagtgaagaggacaggagccattgtggacattccagttggtgaggagctgttgggtcatgtggttgatgcccttggtaatggcattggtggaaagggtccatttggttccaagacccataggcgagttggtctgaaagtccctggaatcattcctcgaatttcagtgcaggaaccaatgcagactggcattaaggttgtaaatagcttggtgccaattggccatggtcagtgtgagctgattattggtaatggacagactgggaaaatctcaattgctattgacacaatcattaaccagaaatgtttcaatgatggatctgatgaaaagaagaagctgtactgtgtctatgttgttattggtcaaaagagatccactgttgcccagttggtgaagagacttacgatgcagatgccatgaattacaccatcgtggtgtcagctatggcctcagatgctgccccacttcagtaactggctccttacactggctgttccatgggagagtattttagagacaatggcaaacatgctttgaccatctatgacaacttatccaaacaggctgttgcttaccatcagatgtttctgttgctctgccaaccccctggttgtgaggcctatcctggtgttgtgttctacctatactcccagtagctggagagagcagcccagatgaacaatgcttttggtggtggctccttgactgctttgccagtcatagaaacagactggtgatgtgtctgcttacattccaatgaatgtaatttctgtcactaacggacagatcttcttggaaacagaattgttctacaaaggtatccaccctgccatgtcggtctgtgtctcctgtcggatctgctgcccaaaccaggtctatgaagcaggtggcaggtaccatgaagctggaagtggctcagtatcatgaggtcaccacttttgcccagttcagttctgacctcgatgctgccactcaacaacttttgagttgtggtgtgtgtctaactgagttgctgaagcaaagacagtatactcccatggctattgaagaacaagtggctgttatccatgtgggtattaggggctatcttgataaacgggagcccagcaagattacaaagtttgagaatgctttcttgtctcatgtcagctggcaccaagccctgttgggcactaccagggctgatggaaagatctcagaagaatcagatgcaaagctgaaagagattgtaacaaacttcttggctgaatttgaagcttaaacgcctgtggatttacatcaaataccagttcagttttgtcattgtttattctagtagattagtttcatttgtgaaagggttactctcatactccttatgtacagaaatcacatgaaaagtaaaggttccataatgtgaaaaagaaaaaagatctctacaaggagaactgccaaccactgctgaaagaaatcacagatgacacaaataaataaaaaaaaattccatgctgatggattggaagaatcaatattgttaaaatgaccatgctgcccaaagcagtttaaagatttaatgctataactaccaatgtcatttttcacagaactagaaaaaactattctaaaattcatatagaaccaaaaaacagcccgaatagctaaagcaatcctaagcaaaaagaacaaagctggaggcatcacactacccaacttcaaactatactataaggctacagtaagcaaaacagtttggtcctggtacaaaaaaagacagatgaatggaacagaatagataatccagaagcagttctgcacacctatagccatctgctcttcgacaaagcccacaaaaaaatgggaaaagggtcccctattcaataaatagtgctgaaataactagctagccatatgcagaacaatgaaactggacccctaccttttatcgtatacaaacattaactcaaaatgaattcaagatttaaatgtatgacctcaaactataagaatcctggaagaaaacctaggaaaaacagtattctggacatcagccttggcaaagaatttttggctaagtccccaaaagcaattgcaacaaaaccaaacactgacatgtgggacctaattagactaaaaagctcctgctcatcaaaagaaactgtcagtaaacagacaacctacataataggagaaaatatttgcaaagtatgcatctaacaaaggtctaatatccagaacctatgaggaactcagacaaatcaagaaaaaacaaacaaataaccctattaaaaaatgggcaaaggacatggacagatacttctcaaaagaaggcatacaagtggccaacaaacatatgaaaaaatgtccaacatcagtaatcatcagagcaatgcaaatcaaaaccacaataagataccatctcaccccagtcagaatggctattatgaaaaggtcaaaaaacaacagatgctggtgaggctgtgtgtgcataaaagggaatgcttataaactgttgaggggaatgtaaactggttcagccactgtggaaagcaattgaagatttctcaaagaacttaggactaccatttaacctaccaatcccattattgggcatatacccaagggaaaataaatcattctaccaaaaagacacatacacttgtatgttcataacagcattattcgcaatagcaaagacatggaattaacctgggtgcttatcaacggtagattgaattttaaaaatgtagtagtagtacatatacaccacagaatactacacagccataaaaaagaatgaaatcatgtccttttcagaaacatggatgcaactggaggccataaccctaagtaaattgttataatataggaatggaaaaccaaatacagcttgttcttacttgtaagtggaagctaaacactgagtacacattgacataaatatggtaacactaggcactgtgaactactggaaggggcaggagggaggggagatgggttgaaaaactgcctgttaggtaatatgctcactacctgggtgatggaatccatatcctaaacatcagcattattccacatacctgtgtaaaaacttgcagctatatcccctgaatataaaataaaatcaaaattatttttttaaaaagaaattgttgtcattacaggaagtggtagatattttgggttctgcctaggctgtttctgaatcagaagggagtccatatgattctgtttgacataagtatccctgctcaaaccattctggaaggaatcaactttatacatggagacatctgtcatctctctgaggtagagaaagccttccaggatataaatgttacctgtgtgttccatattgtcttttatgttatgtcagggtggaaacaattgaatcaaaaactgctggaaaaagtcaatgtgggggacacaggcaatgtcctccaggcttgcaggaggataagagtaataaaattagtttacactagtgcttttaatgcatatttggaggtgaaatggtcagaaatgaagatgaatctgtctttcttagctcttcacctctaaagcaatcactactctcagacaaaattgactatggacaaaaagatagtggaagtaaatggtgtttttcctcccctacatcactaacatcctgaatcccttcccttaagtctgtgaccactgggatacttggtcccactaagatagctttcctccactatgattcctcatctacatgttcagtgtcatcagaagaatgatgtccttttccagatagctgaattacgcagcatttaaatttatcttatttcattttttatgagaagttataatattggaataaaaagcagaaacaaggaaagagattttctgaagtatacattttatatgagccaaggaattagtacctggaaaaataaactgtgatgtttaaaattagtttatatatggagataattatgtttcttgctaaaatgcctatcaccctactgattctcaatttgaaataagcattataacttttacatgtctgaatatgaaattttacaaatttgacaggagaggccagagaattagcttgctctttttccaccatgtaggaataaaataagaaatcagcagtctgcaatcagcagttactggaactcaaccatgctgatgccttgatcttggacttcccagccaccagaactatgagaaataaatatttcttgtttaagccacgcagtttatgataatttgttatatcagcctaaactgattaagacaaaaatgctaagaaacagaaggaccacatagtaaaattccataaactgttctggaattttatatctactactaaggtctagaatccagtaggtcctcatggattgaatatggcaccagcaagggggatgtggacatgagccagatcctaacacaaaggatatttgccctcagacctcctttatggttccttccaggagtgtgcagcccagaataaaggtttgatggagtgactggtgccacaggtatgagcaatcggctcataatgggggcaacagtttggaatcagagaatcatgattattcttgtaaatgatacttatggaccaaagaggcacattgggctcagaacatagcattttttcccctaggtctgtcagcctatatatcttttacaggccaggtatgtcaagagtctacatttgggagaggtcataaaatccatataatatacattttgtacacaatttcagaatttgtaacagattatactcaagatactgcattttatctagtgtgtttttacattataatttcacagggtaacagcttctcattttcaatgctaggttacttttatgtgatattcacattttgtaccaatctggtgttcagattttatattgcttgatatgattttttaagtgcataatcactttcttaaagtttctgtttaaaaacttatgggaagcatgacataatataaattatattagagatggaatacttaatatcccctaaaataccagataacttagaccagtatcccagtatttaaatatatagttgataactcaaagtaatttatcactgtttctctgtaatcattttgatgtcacaggttgtttaaggcttaatgatgattaagaacatttagtgaatttatgaacactttaatgaattgatttaacatttcagctgtttatgtgcaaggacccataaaattatcaatttaaatgacttgagaattaaaatataatagtttattcttggagcatctctttttctctctccagttattggtcaggctatcaaatgcttttttaaaaatctaagttttaaatatttttatttatttatttattttgagatggagtttcactcttgtcgcccaggctggagtgcaaaggcatggtctcagctcactgcaacctgcacctcccgggttcaaatgattctcctgtgtcagcctcctgagtagctgggattacaggtacccgccaccatgccccactaattattgtatttttagtaggggaagggtttcaccatgttggccaggccggtctcaaactcctgacctcaggtgatccgccccgattggcctcccaaagtgctgagattacaggcgtgaaccaccatgctggcctagatatttttacatgagattgtggatgataatctcattttgggtagatttgtattctgggtagatttttatcagggatcctgatttaaaaagaaaaaaataaattttttttctggttatgattagcatttttcattaattaccacctattttagttaaggtagctctatttaattcatacaacattttatttgttagtgcatggtgcaattaaaacaatagttacaatgtcatgaaggacctgcgccaagaatcacatgacaccacatagccatcagtacctatgacaatgctacttttaaattctcattttttaatgagaatattgaggctccaagatgttaagtaactttcccaagaatacacagctagtagattcagatttataaggccacaaagcctgggttctcagttactactctgctcactggaacttgtgggagcaaattctgatcaacttataagctcttcttccccaaaagatcttatcttggagaagaaggagacctctatactgcagagctaaagttttgagtaggtcgtgcttgacttctggggcatgaaaactggttttatgaaggtaaaatcatcagcatttccatggagcatcttgtgtttctcagggcatgggaaccaaccatctgcagtataaagtaaatttttaactcataagtcaatggaattgttgttggtatggatatcaccatattatttggcaggtgattcttttttttttttttttttttttttttttttttttgagagtctcactctttcgcccaagctggactgcagtggcgctatcccggctcactgcaagctccgcctcttgggttcatgccattctcctgcctcagcctcccgagtagctgggactacaggcgcccaccaccacgcccggctaattttttgtatttttagtagagacggggtttcaccgtgttagccaggatggtcttgatctcctgacctcgtgatctgcccgcctcggcctcccaaagtgctgggattacaggcgtgagccaccgcgcccggcctaggtgattcttattgaaatatcataaagggcaagtattgtgacaacttttctccatgattaataaaacaaacagataatctttataatactaatcattgctgtttctttataaaatgttcttgattacttaaagtactattaaattaaaaatcagatttttgcaacatgtagaaggctcttttaaaaaaactataatattattctatgttgtatttctgtaggtataatatcacatcaccataatctgcatggtctaataaaataatagactgtttctcaataaatagctttcccacaatatggaaacattggcaatgttttgttttgtttttttgtttgttttgttttgagatggagtctcgctctgtcacccagactggagtgcagtggcatgatctcggctcactactacttccgccttctgggttcaagcgattctcctgcctcagcctcctgattagctgggactacaggcatgtgccactacaccaggctaatttttttgtatttttagtagagatgaggtttcaccgtgttagccagggtgatctggaactcctgaccttgtgatccacctgcctcagcctcccaaagtgctgggattacacgcatgagccaccacatccagccggcaatgttttttaacatgtagtttagtcttcagaccctctcaaattacttactgaactaaagtatgccttttataagaaacaacattcagtaatataaaaataaactctcatctcttctttactttccatttaatttaaggtacattttggaggacattcttgtgcttacttcatgtaacctcacttgcttttaggtgaattcaaaattctaatgttaatcccttgtattagggttctctagaggaacagaagtaataggatatatgtatatacgaaagggaatttattaaggaatattgacttggatgatcacaaggtaaaattccaggataggctgtctgcaagttgaggagcaagcaagccagtggtggttccgtctgagtccccaaacctcaaaagtagggaagctgacagcgcagccttcagtctgtggccaaaggctcaagagcccctggaaaaccactggtgtaagtccaagagtccaaaagctgaagaacttggagtctgatattcgagggcaggaagcatccatcacaggagaaagatgaaggctggaagactcagtagtctgctcttccatcttctcctgcctcctcgctggcagctgattagatggtgcccaccagattgagggtggatctgcctctcccagaccactgactcaaatgttaatttcctttggcaacaccctcacagacacacccaggaacaatactttgcatccttcaatctaatcaagttgacactcaatattaaccatcttcttactgagcagttaactcataataacactgccaaagagaactctaacagttaacagaagcgtcgtttgttgtcctaagtctgtcataatattctgtataacctttgaagaaacatttaaattttcctctttcaagcaatgaaatatgcattccttaaattgaaagaacatgagcctccttgatgcgttgcctgacatggtgggaaaggtgagcccctgagtcggaggactcaccccggatcccattctctcacaggcttgtgaaagcagaagtcaccttccttctgaccttggcatgtatcctgcttcaagaatggaactggaggcatatctattcttattacaaagaaaatttaagtcattctcctatagaattttaatttcaatcattgttttaggaatttgcaaatatatggcttgctttgtcttaactaatagaaaaagtgtcctttttcaaaaagagaagtgttaatgtaatgataatagtaatgacttcacagaatgtgtgttctgttccaagcactttaagcatattaacaatttaatcctcacagtaatccttggaggatgatatcatcctgattttgcaagtgagacaactgaggcacagaaaggccaagccttatatagcagagctgggatttgaacccaggatgtctggctcttaatgctgttagtttacattcttaactgtgggccagatgtgtgtaactgactatcaaacgtggttctgacacaaaattctacatctaaattccaatctccattttacatttctgctaacctgacgggggaaaaacttttattttaatatgaccagggatccacattttgaaaaatattgccagtgcagtcctgacagccacttcttcattcttaagcacctgggaggaaactgttcagaagtggttggttatgaaatggtaaaatcagctctgccctgctgatgaatccagaataattaccaatgactaagtccagcctcatgaccacttcttgagtgacattgagtttgcatcctaatttgaagtttacaattctggcaagatattggacagctgcagggataattttgttcacaaatatagatgcaaaattctatgctgcgttaaagctattttaaagagcatattttaggactagtgtttatttccttgtgtctaaatttcctgttttgcatttgcttcagctaagattgttttgggctaaacttatcttcctacacagacccttgatatcatgtaaatcaaaataatcataggcatatttaattatatgacatttgttgtctctacactaaagtttttctaacattcttaaattttgtctacataatgaatatatttttaacagaaaaaaaaactataggtttgattgcctgcttatttaaataaaaagagaaagaagagatagaagaactatgaactctttattggttgccaaacaataaaaatacctttttgggaaaaaagtaaaccccattgtttccttgaatgtgcttgttctttcagctcagtcctaagagtggatgattactgagcacagggccctgagatgaactgagggactcacatctcattcaagcctcacaaagcagtggaaggattaatgttttcttcattttataaagagcacactgagactaagaatggttgactagtttgcccaagttctcaagagtagtaaaattttgagccgttaatttaaaacagaccatctgtaggtagactagagctgagaatgatctcaattaaaggaaggaattctgtcactttgtggagttttatgaagagataagatagaaaccaacctactgagtattaaacaaaaggctatttcccgaaaacatccttccacattcattcttcaatcagtaaaattttactaccattaaggcagaaaaagggttagacacaattccttccttcaagaagtttagaggttaatagggacactacaatattcgtgacataacttaaaactacataaaaatggtatagaaaggtaaagatttctctgtgaaagaggtataaaaaagaaaatattttcctcatggtaagcttgaagtttcttcctccctgggaggcttaaaggagtcttcgtgatggagatctagaatccatctttagttggttagtgtgtgcacatatgagagggaaggccatgctgggcctgatccaacaatgaggctggaaatgggtgtacttttaagaaaatgaataaataaataaatgatcttgtttgcctaggagcctgcaagggactaatggaagctgtgaatagaaagaccctttggaaccaatttggagatgtccttgaaaacgaggggagtatagaattttctccaaaagaaaataagaaacctttaaaggattgtatctgcggaggggcaagatagtaacaaaatcttcgaagaggaaataagcctttacctcaccgctgttcaccttgtttgagggcttacctttcacagcatgggcccctgctcctggccctccctattgcctaggcagagtttcactcttagcctctgtcaagtgtgatcaccagctgacttatctatatctttttttttttttttttttttttgagacggagtctcactctgtcacccacgctggagtgcagtggcgcaatcccggttcactgcaagctccgcctcccaggttcacgccattctcctgcctcagcctcccgagtagctgggactacaggcgcccaccaccatgcccagctaattttttgtagatttagtagagacggggtttcaccgtgttagccaggatggtcttgatctcctgacctcatgatccacccgccttggcctcccaaagtgctgggattacaggcgtgagccaccatgcccggccatctatctcttcttatcagtaattgggcagtcttgatactgagcttcccagctgtggacccacaactaaattaatgtaagacccaaagatctgaaacgccctttaagatgccaaccttgagaataaagaatgttagataccagcagaggtttatgcaagaagaagatggagtggtggagaaaaactgggagtaagaaaattaaaggaagagaaaataatagaaaagaacagtgatcatttgtattaaataatgagagtgaaaatagggctaacagtattttacaggtgtagtggatcacaggttgttgacatgtaaccaacaagaactggacgatatggctgcaaccctttgtctgcaaaagctcacatgtattggctagtaatgttcaagtaattaagaggacattaatcagttaaatatctatccacacatgttttctctaaaaaaattcaagtctccattttttttctgtctaatacttctgacttcaaggatagaatcaagagaactgggaccaggaattgcaactattgcaatgaggcaaatccccacaatgtcccaggtcagagttgagagaggcagctaaacaatgggactgtacccacctatgacatgaccttttaaaacagctctttttttgtgcttctttagatggatagaagtgaacttatatctatgctttgatttttgcaaaattcttagtctgtaaaagatatagttgtgactaggagactaactctcatttgcctcagtcctaaattcagtgtgttcagtataacattgaggaaataaaaatcataataatgatttcagaagtgacatattaactccatatttttgaaagaaagtgtggtcaggctctgtgctaaaaaaaattctacctactgatgttgcaaaagcgtgtcttgagatgatctttataatgaaaactagatttctgtgaatgtgcaatgacttttgggtccttttcttttcatattcaaatattatttcccttctgtgatatttccccttatttatgggtttctttaatcatatgcatatattttttatgttgaaacctagtaaaggtataagcttttgtttcatttttagcatgaacctaagaagctcttccatcatgatctatggctttcattattgattctgtttatagacaggatataaatataatatgaaaatcaaaaacaagttttaaacaaaaattgtttttaaaattagatttttctcttcaacttaaatattttacccttccaaagggtgagggaagggggaaagatgaaagtggcagaattaatgtagaaataaaatgtttggagcagagcttgggctttttcccatagagtgaatactaaattttatcagtataatgatccatcacagtttaaagaagcaacacattttccaattacaatgataacttttaacatatctaacattttaacatctctgtatcttctaatatattagacttgaaaaattctgtagtgattgcttgtctcagcattttgcaaacatcatccttgctgtaccaaaacagagttcgccagttttggaaagatgtgtgcgtggctgaacctcttctgggactggacaacggacagcaactactatacgtgcaagtagttgttctctggtgagctgaaacagttactcacatcacttcccatgctctgaggttcagatgaggagcgctggtagagaaaggcagctctagatctttgtaagaaggtaataagacacgaaactgtgcccttcaatggaaagtattaatataatacgtctctccaaggaagggctgacaatgggagttgaaagccaccagacagtaagtggctctcaaaatgagtgggaaggtagttacacaaagttggtgcccccatacttgtctggaggcctagctgaagaaccaatcctagcatgcccctccaatcatcgtggccactctaggaaccagccctagccacagccctactaggcaagagttgtcatgcttcttttacaaacttcgagtagacttaaagttttccttttgtcttcttcaccagagaaagaaaaagtttacttttggacaggttgcattaaagcactttagatattctcttttctctggtggaagcccgtatcttaggagacatggggagcctgctgctggctcacctgtcacagaactggatcatgaagctttcatctggtttttcccaggtgggcattttaaatttctgcttcaaagtctgtctttgtacttttaataaataagacatttgtactgatggaatctgcaagacaggcttgaaggaaaaaataaatgtctcaaagtgaaagtcagtttctttttacatgaacagtcatgtaaaaaatgtattaaaaatagcctttttgacttggagatctattatgttcagtagctaaactataacacagaagaccacatggagcacatacatgaaatattgttgaggtggccatttggagtcctgggttctagtaaggactccacttcaattggccgcatgatccaaggatgggcatatcacttctccaggacttagggtcttcatctctaaagtgaaggctgaacataacaggtacccttaaagctgcaaagcatcacacaacatttcacacctgtttaccctctcattctcttagataacactttttctctcttttctctttcctcaaaatgccagtgtctcttctcccagtctcattcttagctccctacttcaccagaaaactgaggcaatcaaaaaagaatgtccatgagcttccaacatcacattggcttatggctctgatctgaatgtgtctcctccataattcaggtattgaaacttaatggccaatgtgacagtattaaaagatgggcctttaaggccatgcgggttcctccctcatcaaagggataaaggtctttctaaaagaggcttcacacagcgtctggccctcttgccatgctaccttctgccaggtgagaatgcagcgaaaaggacctcaccagatgccaaaaggacctcactgtctccttgatcctgaatttgtcagcctctagaactgtgagaaaattaatttcttttcttttcttttctttttttttttgagacagagtttcgctcttgttgctcaggctggaatgcaatgacacaatctcggctcactgtaacctccgcctcccaagttcaagagattctcctgcttcagcctcccaagtagtgggcattacagttgtgcgccaccacgcctggctaattttgtatttttagtagagacagggtttcaccttgttggttaggctggtctctaactcctgacctcaagtgatccactgccttggcctcccaatgtgctgggattacaggcatgagtcactgcacccagccaatttcttttctttacacattactcaggctgtggtattctgttataataacacgaatagactgagaccaaaattgataccaggagaatggagtgttgctacaacaaatacccgaaaatgtagaagcagctttggaactgagtaatgggtagaggctggaaccgttttaaagggaatgctgaaaaagcctgtatggcccaacatggcacattaagggtgattctggtgagggctcagaacaaaaggagagctgtagggaaagcctgaaccttcttagtttatcttagacaagttcttatattatctcagtggttgtgacgagaatactggtagaaatatggacagtgagggcctttattatggtatcttaaagagaaatcagaaacaccttactggaaactggaagaaggccatcactgttacaaagtagccaagaagttggctgaattatgttcctgcctcagtattttgtgggaggtagaacttaagagtgatgaactaggatacttgatgaaagaaatctctaagcagcaaaatgttgaaggaattgcacggcttctctcaactgctcatagcaaaatgcaaaaagagagaaatgacttaaagatggaatttataatcaaaagggaagctctcacatgtaaagaatgtaaagatttgaaaaattctcagcctggccatgtaaataataaaaaagcatgtttagtagagaaaaccaagggtgtgcccagttgacagtccgataagcaaattagtgtgaatagcaggaagccaggagcaatttatcaagataatgagaaaatgaccccaaagacatttcagagatctttgaggccaccacattcttcacaggcagagtgctagggccttgggggctgaacaggtttgagggaggggcccagggtgcccatgggaacttggggcttaccatccagggccgcctcaaatctctgctccctgcattctggcacagtgctccttggctgccccagctatggctcaagcaggcccaggtgtgactcaagtcactgcttcaggaggtataggccatagcacttggcagcacccatgtagtgcgaactctgcaagtgcacagagttcaggagctttgaaggcctagcttcctcccctaggtttcagagaatgccacagagtgtctccaccagaggaatacacagtggagctgtgtgagtggggccacctcagagagtactcactaacacaaaatctagtggaactatgggggtagggccatgctggagacctccacattttagagtcaccaggatgcaatgccagcgtgaaagagctgcaggtaggagactccaacccatgagggctgtggtgtgggctgtgcccagcaaagctatggggttgtggcctttggagccttggggatccaacccctgccccagtctgccttgacggtaaaacatgagtcaaataaaattattctcaagccttaagatctaatgttgtttgcccttttgggttttggatttactcagaacttgttacccctttcttttagccaatttctgcctttcaggatgggaatgtctatcccacacctataccaccattgtgttttggaagctaataacttattcgactttgcagcctcattgctggagggaaatttgcttcaggatgaattgttccttgagtctcactcatacctgatttacataaacctctggactttagacttttgagttgttgttggaatgaatgaaaacttttggggctattgggatggaattaataatgtattttgcacatgagaaggatatgaattttgagtggccagagaagaatgctatgatttgaatgtatttctgccaaaattaatatgttgaaacttaatgaagaatgtgatcatattgagaggtgaggcctttaagaggaattaggccatgaggattcctcctccatgaataggattaaggactgtcttagtccattttatgctgttacacagaataccacagactgggtaatttataataaatagaaatttattggctcactattctggagctggaaagtccaagatcaaggggctgactcctgcctagggccttcatgtgtgtcctttcatcgtgaagggcataaaaaaggggtgagagagaaaaaagcaggccaaataggtccttttatagggagcccactcccacaatagcagcattaatccatttatgaaggcagagccctcatagtgtaatcacctcttaatactattttaatgataattaagtttctaacacatgatttttgggaggacacattcaaactgtagcaaagcccttaaaaaacaggctaaatgcagcatttggctctcttgcccttctgccttctgtcatgtgcacaggcagcaagaagggcctcaccagacatcaaattctggcatcttgatttcgggcttcacagtttttatacctgtgaaaaaattaatcacccaatctgtggtcatctgtcacagcagcacaaaatgaacaaagacacttacccaccagtacctacaccctcagagtctgccttctcaccttttaacttttaaccttttaactacccttacacatatacaaagctcatacttcacctattcaaaaatagaagtcgcaagattagctcacctctggcctttggatttttccttggaagattctattagcatccagtcctgctatattccctatccttaagggcacgacaacaatagaacacaaacaaaaagaaacttttcttggctttactttctctgcgagctcctgtcccatttctattctcttttgcaacacaattccttgaaggagttatccacactcttttaaaatatttttctctgttattcttgtaaacacagtccaatcagatttttcagcactccccctacactgctcttgtcaaagtgtccaacaaacctcacattgctaaaatcagtggtcaactctcaattctcacattactcacactatctgcagcatctgatataattgattacgactcttccttgttaatttttttcttgtttcagtcagtcttttggcattagttccatccatatgccactgacttccaaatgtggctctcttagccaacacctctctcccaaactgcaaactaaaattccaaaaggcttatttgactctttttagatgtcttagagatatctcaaacttatcaatgttcaaacctgaactcctgatctttgcattcaaaactttgtttacctgtaaacttcctaatctcatctggtggaaactccattctcacactagcttacaccaaatatttaagagtcagactcatttgatggtctcttatgagctcacacttgcagtttcactcctatggagctcagccagggctagaacttccattatggtttaaatcatatggctggtagttgtgctgactactggctgactctggggctctgttctcctccgtcagtctagcttagctttctatcagcaaggcagctgcattccaagacataaaaaatggaaggtgtggggattcttgaagttttgtctttggagttgcacattgtcatttctaccacatgatattggttaaagcaactcataagattagtccagatttaaggggaggtaagacagattctatgtcttgatggaaaagtggaaaagtcatattgcaaaagggcatgtaagatagaatggagtgttgcagtcgtctttggaaacaatcgaccgtataggacatcttcaaattacaaaataagctacttgccctagaatgtgccctctttccccttctgttacaagcacatgacccagctgtgattaggcagatatggaccataccctagggcatggaatagcaaaaagttgaaagaaacctgtacttggataatcatgcaaagctgagttgctcatcccatgactgttaggtaaagacaaaaaactttcttccatctccgtttctacccgttccctttcaccctcaccccttgtatctttgatgttccctgaactggccaggcactctccagccttagtccttttaattgttctgtccacctgaaacattctttccacaaatatctacagagctcgcttcttcacttcatgcaagggtttatttaaatatcacccacttaataaagtatttttgaccacactttttaaaataaaaatccatgactaatgaagactgacacacatttagtcctttgaacaatatctagataaaaatgtctgtggagtgaaaagaataaatgctgactttgctgttcactggttttcttcaggaaagtctcattatttctcagactacttcatcagaaaatggagataacaatggctttcttttacggtcattgtgaaacttagatggccccgtgtttgagaagtcctccttatgaggtcgccctcatgattgctcttcacttgagttcaggctcccgctctttgtcactcccctttgtggagacagacagactttctggagctgactaaccttgactaacctctcactacccaacccacatctggctacaggggaaagaacattgtcacaggaactaggctggttgtaccatccccacaagagtgtattcagattcttcttgagaagagtctagaattgcaccagaactctgatccccagcccaaaagcttgcatcaatgtggtatttttataaacatgtacatagtgaaatgactaccataatcaagctaattagcatatccatcacctcacatatttaccttccttttttattgtatgagaactcttaagatctattctcttagcaaattccaagtatacaatacagtattattaacaatagtcaccatgctgtacattagatctccaggacttatttctcttgcataacagaaattggactctttactcaacgtctcccaatttcccctacccccaacccctggcaaacattactctatgctctgctacctggatattttgtctctctacgtacattttagattgcacaaaataatttgctgttgtaatgaatggcattgcactggatccacaaatcaagttaggaagacatcttgacaacattgagtctctctatccatgtatatggaatagctctccatgtatttagttctttgatttctttcatcagctttatagctttcctcatatagatcttatacaaatttggtagatgcatacctatgtttttaatttctaggggtgctaatgtaaatgatattctgtttttaatttcaaattccacttgtttattgctgatgtataggaaagtgattgatttttggatattagctgtgctcttatttttatttccctcattttccttgttttgaatttactttgttcttctttcttatttcttgagtaggaacttaagagtattgacttgaggacacaaatgatgctgaatagccaaaacaatatttagcaaaaagaacgaagctggaggcattatactccctgatttcagaacatgttataaagtgatattaattaaaaccacataggtactcctataaaaacagacacattgaccaatggaacaggatagaaagcccagaaataaacccagccacttgatttttgacaaaggttcctagaacacacagtggggaaagaacagctttctcaataaatgctgtgggaaaaactgagtatctgtatgtagaagaatgaaatgagatccttatatcataccatatacaaaaattaactctaaattgatgaaagacttaaatataagacttgaaactgtaaaactattacatgaaaacagagaaaatgatccaagatattggtttgatcagcaatttttttggatataaccctgaaagcatagggaacaaaagcaaaaataaacaaatgggatgacatcaagattaactatcttaattatattatttgatgaatagaagtcattaatttatagaagttcaatttaataaactttaaaaatatttggtgtctttttggtcctatttaagaaatctttgcctatctcaaggtcatggaagatattttgtacttttttgttatagaatttgtattgtttttactgtctaagcttccacattgtggcctatgatccatcctgaataaatgttgctaaaaattaaactttgacttagcttactataaatgatatttatatttatgtattacataatttatttacatattctcatatgtaatacatattattttactataaacactataattaaggcagaatagatagtttagatacatattcatgaagatgccacttccattcaacggacaaaaggatagtcttttcaataaaatttactaggtcagttagatatctgtagatgtggtgggtaattttgtctttaaacttggctgggccacagtgcccagatatttggtcaaatattattctgaatgtttctgtcaagattttttcatttggataagaacaatacataaatcagtggacttagggtatgcacattaccctccatagtgtggatgggccttctccaatcagttgaaagacttaatagagcaaagactggccgggcacggtggcttacgcctgtaatcccagcactttgggaggctgaggtgggcagatcatgaggtcaggagatagagaccatcctggctaacacggtgaaaccccatctctactaaaaatacaaaaaattagccgggcgtagtggcaggcacctgtagtcccagctactcaggaggctgaggcagaagaatggtgtgaacctgggaggtggagcttgcagtgagctgagatgccactgcactccagcctgggcgacagagcaagactctgtctcaaaaaataataataataataatagagcaaagactgacacttcctgagcaaggaggaattctgctagtagactgcctttggagtcaaactgcaactcttccctgggtctcgagcctgctggcctaacctgtagattttggattaaccaagcccttacaattgtgtaagccaattttaaaaaataaatctcttgatatagataggtagatagatagatagaaggacagatagacattctgcttttctgctggttctcttttcctggagaaccctgactaatacaattcggaaaaacacgtatcttgacctgcacttcaccatgcacaaaaattaatttaaaatgaatcatagtatcctgctcatttttaattcttcagataaaaatttacctactatatctttagaataaacttttaataaaagttaattaaaattaagttttaattttatttttatgtttttttctctcccttgtgaaacagtagtacacttgaaaacaggagaattttttttaatgttaccaacgcagttcctggtaacaaatttttagaggctactatgtgtcaggctctgtgataagcattttaagcactttacttccataagtcctcggaataatcataccctcttatgtaagtattattatgaccaccaaatcacagataagaaaacaagcattagagagaaattaagtccaactgattctaaatgcaggacgcttgtacactaggtctccctacatggctcctcaataaataaattcattaagaaataagaaggggctgagcgcagtggctcaagcctgtaatcccagcactttgggaggcctaggcaggcagatcacgaggtcaggagatcgagaccatccagactaacatggtgaaaccccatctctactaaaaacacaaaaaaattagccgggagtggtggcgggcacctgtagtcccagctactcgggaggctgaggcaggagaatggcatgaacccaggaggcagagcttgcagtgagccgagatcgcgccactgcactccaggctgggcgatagagcaagactccgtctcaaaaaaaaaaaaagaaagaagatgggcttaaagtttcataaaatatcagtcatatgagaataaggaaaaggaaaaaagaatgtaaatgaaagataaagacagagaacaagaagaaaacacagcggagaatcagaaataaagaagaatgttgaaagaagagaatatattactatatttatttattgaatatattgattaggctctgttctaggtggcgggataaagatagatgtattatctatgtaaataatatataaataataaatatatattacataatttataaacaagataaattatctatttatagtccaatcatgaagatggcacattaatacctgacaataacaggtagaaatagagccagtgaagatgagacagaaagcatcataaggatcgggaaacacaaggacaacattgaatgggctggttttggagttttaactctgcctcaagaagttatggtacttgcctaagcaaagaggtggaagtcttacagaaaaggaaaatatgagcggacatagctgagtgttggaagaaaagatgagggttgagctaagttgagctgccagggtagagagtagggcagaagttaatttccaacaaggtgctcagaaggatctgatcatggaaagtctgggttttatagatttcatccttttaacagaggagcagctaaagcagacctttcctttgggacgattgtcaggacggaggacacagggtcagttagagaagggtaacagaagtgacgaatgaccatggaagcttatgggtggtttaggcataaggtaaccagggcctgagaccagagaaattccagcagcaagagaaataagagaaaatagaaatgggaagtataggaaaaggaaacattttaaagctcttattccatctctgggcgagcttatacgtatacggtctagagttttttctcttgttgatggtgaaagggaataaacagcatgaaactcaccctggaggctaagatagtttgactcagagttccccccaccgcttgacctttcatgaccctgggtacacactaactctgaagttagtgggcaaggtgggcaggggctcatggactccataaaatccatctgactgttagctctgtctttcaccaggtgggggggccaggggctgtggcttaacctcattgtgcctcagccaattcttctgcatgtaaaatgaggatattcactatgtggccattgtgagatgatccatgaaaacctgtgtagcactgagcacagtgttctcagtaaatgctgagccctaatacccaatatacccacagctccatgcatgtgctccttagcaagcatacgcagacagcttggcttatctgcttgtgtcacattataaaagttggcttcctggttatttctacagtgcagcccataataccgatttccttaagagcaaaaaaaaaaaatgccttatttctttcctcaaaaatgagaattgaccttttaaaacttttcctcaaatgacaggactggtgctgtaaatgcttatgaagactggtccctttgcatgtacgggcttatcttcctgaagatatgaagctgtggctagctgctttcttctgtttcctaacgaccacagaatgcacaaagtagaggtgcaagtggaagctgcaaagagctctacaacctctgtcaaggtgcttgtccttgcccaagctattactgttcttggtggagattattccccgctgatctaaaatatgctctaaggccaaggtgggcggatcacacgaggtcaggagttcgagaccagcctggccaatataatgaaaccacatttctgctaaaaaatacaaaaattagctgggtgtggtgatgcacacctgtaatcccagctactcgggaggttgaggcaggagaatcgcttgagcccaggaagtggaggttgcagtgaaccaagatcacaccaccgcacttcagcctgggtgacagagagagactccatctcaaaaaaaagtaataataaatacatcataaaatatgctctaatgttggagccaaaggtcagcactgtcactacacaaagcctcactttgagtagagatgcctgctgctgctatttcttgggacatgagcattctttaactgagtttaaaagttcttgaattataaatggatagaaatacagcttcacagaggtatgctcataaaggagtcttcacacttgaagatacagtggacacatacacacacacacacacacacacgtttagagaagttcccttaatcaatctgacagcatgtagttataaaaaacacaaattggccgggcgcggtggctcacgcctgtaatcccagcagtttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggctgagcttgcagtgagccgagatcccgccactgcactccagcctgggcgacagagcgagactccgtctcaaaaaaaaaaaaaaaaaaaaccacacaaattttatgaggtgacggtacagcttctgcttccctatatactatacctctggagaacgaagagcactgaatactatatttttactttctatgtttggaactacacttattatcatgccattactcaataaacatgcatcacaatgtccccataccaccatgaatgggcacaaataaccccatcctattgtggtggggttaattttttaggacagcaggtgctgtccactgttaagagcgtcagtttgcctgattttttcaagtttattctccaagagcctttcactcaggttgggtctgcaaagcaccagcaagtccaacaactcaaccaaatgtctacagctgcgggtggcagataagtatagcagctaacccaaagcaaataaaaacaactcctaggggaaataagagggatgctgggagggctttttatttgagtgccactgtggtcttactgatttgagtgcccacttgtttcagaatttagggtgtgggagtgaccaaggatcacagtgactagaggaaactagaaacaaaatagacattgttcactttggttgctaaatttaatatgtccctattgcactttttgttttgggaaatttttccaacattaagaaaagcccttttaaagaagagtgttaaaacattggttacatgagaaccaaggaggattcaccttacaaggtgaaattatgtgttttattcaattttcacactactataaagaaatacctgagactgtgtaatttataaatgaaagaggagttttttgttttgttttgttttcactcaaaattcttcagtttttacaaaactaacagggtggagtggggaggctggggggcaggcagcctcaggagtagggctggtgagaggcgctatgcttctgtctccacctgagactggctccctgctgtgttgctcttccactccgccttcatctctgtgtcagtgggatggtctcctgagcaagcctctgccttggccttgttctcctcctcagccagcctctcaaacattttggcatagaacttcttccgggcaagctgcctgtggatccgctgctgacacacagccagctgggccctggcggctttgttgttggggtagagctgcaggaccttctggaagtcagcccatgccagttcaaagtcattcaccgccaggtgggcctctccccggcggaaggggcccttctcgttgttgctgtccagttctagggccttgttacagctttcaatggcagcagagaaggcctgtagtttcagctgacacatggccaggtcgaggtgagaggccagtggaggggcctgtgccttctgtgcttcctcattggaaaaactagacatattccagccaggacacaatcttcttacactgtagtaaagcttgcttgtatttgccttccttgaagtacacactgccctgctctttcactacggtgttctgttccagcttctcttctgaaatcatctcccaagattccttggccttttcaaaactcttgagatataattcatatttcagctcggcatttggtgggatttggaacttttccttcccaacactgccaaaagcatagctgggcttgaggtacacagtggaatgttctcctttctccaagtgctgaatggccctctcgagatcataaggcagatccaggttctccccctcactaacctcaaagcggagcgcccgttggtcaaagagctggtccttgcagcacccttccagcgcaacctccaccatagcgccctcatcgggcttgacatagccttcaccgcgagtccctattctgcggatgattcccccatctttcaaacacaagcgtggcgttatggggagatcgttggaggactgtctgctgaactctaggcatattctggtttgcaggtgatgtggcccacctcccccaccttcatggttgctacggcaatgtcccaagccttgatgacctccccttttcccaggtcaaaggagaatttgtccttgcgatccacactggagtcaaactttgtgccctctaacagccagccagtgtagtggacaaagactaggtccccagtcatgggcatctctgtacctgtgccctctgtcttgatgactttcagcactccttcatcctgtttggggctgacatccacttccttcttgggcagcggcaccggctgcgccgcactctcggtcgccttcatctccttggctgtcatctctgcgtggcgcgaaatttttccgggagatggcgcaggcgcgagtgcactctgggccgcaggcgggggcgctacctgcagggcatgcgggaggacggacactaccgcgctgactgctgaccgcgcggaggctggagcacctctcaggaaacaggtttaattgacacagttccacgtggctggggagggctcaggaaacttacaatcatggcggaaggcaaaggagaagcaagtatcttcttcacgaggcagcaggaaaaagaaaacaggcgaaacttcctcttacaaaaaaaccatcagatctcacgagaactcactcaccagcaccagcacagcatcggggaaactgtccctgtgatccaaccaccccccaccaggtccctccttggacgtgtggggattacaattcgagatgagatttggatggggacagagagccaaaccatatcagtatgtctattcagaaaaatgtttatacatatatatatatatatatatatatatatttttttttttttttttttttttttttttttttttttcagagtgttactctgtcacccaggctggagtgcagtatcgcgatcttggctcactgcaacctctgtctcccgggttcaagcgattctcctgcctcagcctccggagtggctgggattacaggcgcccaccagcacgcccagctacatatatatatatgtatttttagtagagacagggtttcaccatgttggccaggctggtcttgaactcctaacctcaggtgatccaccagctgttgtaagccactgagcctggccagaaaaatgttatttatattctaatggtaccaacttcaatacgctttatcactctgaaccacagttttttaatttaataaggaaaattgggtagaaaaatatattaaaatatatattaatctatcaaatactacacaaagacaagtctttaaatgggttgggcaatatgctgaagttgaacaccagtaaaacgttgagtaacccctccatagaattcccatagaaatctcttccttaccataaacctaagatcattgctctctctcactaccacagggatgtgattttagcatttgtatccaatttacgggtagcctaagccatcagtgagatatttggcattctgtatctaagcctgttccctcaccaccacacttcttcatttctcttggttctattctatctgtagaagacactgaaaagtgacgagatgtgctgttgaaaatctgtttcaaaatcatacactcattgctcactaaatattagctcttcagtcccctggaggtacctgggatcagtctctcccgcctctctatgtagaagagggaggggtactctgacttttgggcggttgtatattctctcggttttcaaaaatgtctactaattaaatgccattggacatgtgctcctacttcctgtgggggatgagacacagtgtgacacaaaagacaaaatgtcctttctgtatgttattatgtcgctttgttcatattctgtgaccctacacatttataatgtcacctttacctttcattatgttcatacgttcacactatattctgagacccctcatttcattgttgatttgtcgatttctgaacaaacagcagttttaattattttaacttcagacttttcagtacgaaaagtcatatctgatttttatcttgcttgaaaatgcttcttactcgtattctcctcaggatgaaattcccttcatcccgatactcagtaacctcattaattccatccattccacctgactttctccccatctattagctcctgctgtattcgtttctcatcttatcaagcttaggaagaatatcgtccattatttaccatttcctctcttgtatcattagtcaaaactgtgtttctccaagtgtggtccatgaaactattgcctccgaattaccaggggtacttgctaaaatgcatattcctaggccccattcaatctggaatgaatgaagcttgaaatctgcaaatggaatatgcgcctctgaagtacattatcgtttgatagctgcttccctagcctctctgcccatcgcatggcatcactctcacaaaccctgactcaggatgaacctgcctttctgccttcttatggcctttaactaactggggtgagtggtgtgactgaacgagcatcaccacaatccacttcaacaggcttcaaacaccactgataatcctgatacagaagtcagcatctgccacacattctccctatcagcagtgacccaagtgttcagtcccagccagtacctcacttcacttatattgagtttcctttaatgggccactgttgctcttttctcccaatacttgtgagtctgagacaccctagtttatcaaacatgttctaaatggcactgaagctcaaagagaaatggtctggatgccacttcccttctgcaaatggctcttttatatctctataaatttgcaaatgaaaaatagatacttctagaagcaggagcaacctcacttatcagaccattgataagacaaacatagttacaaccatcccctgaaccatgcattgggcacttgccttatacctgttatcatgagagggactgtccaagtggttcatgccagagaaaaagagagttttcccaatgtaaatgaaattaacctctaaggatttaatacttctagtaatttcaaaatgattttaaaaaattaaacttcttctttgctccttaaatttccctgtacctcacactataaatgagtgcacaagaaagattaaaaaaaagatgacactaaaatttttgctgttatttgggaatgatgaaaataggagtgaatttttaattattatttttacaaagtaacatttattaattttgtaattagaaggaagaaagataatatttatttcacaaatatgctccaacttgaaaatgctttgaagatgaggggtgaggtcagcagcccgctgtgtcagtaaggtacttcagccttgggtcctgtacacacttacaacagcaggaaaatctggtgctttgggaagaggtgtccacaggggctaaggcacaaaataagagggctgcatatggactgtgtgaagtaataaattcctgaaggcctgcttattctatgtatttaatatttaaaattacccattcaagcatggaaaagacaatttagggcctttataaccaaagaggataagaatgatctgttctccttaatggaaccccagagactagaatttaactatttcctggctccattccacttctaccaccccaatttgagtctagaactcaaagtacaattcatcctagattctatgcacacgtacaaatcatcacatttgttttacctagaagtgtaatggtaacttagtgttgcaagaaaagccctatgtctattcagaaaatgttatttatattctaatggtaccaacccctcccttgacttgtctctgtaaccattctggtaaaaaggaggaattaaggtaaataggagggattacgggttgaagatggacaatcactcaaaacttgaaaagaaaaagtcactccactgcctaaagcacttcaatgattgcccattgcattcagaataaaattcaagttgcttatcctgacctttgaagccctaaacccttccattcctctgtctttctcagtttatcttatgccagtctctctctgtgccatcctcatggacatgaatagtcttctttggtctgaagattattcttggttgctttatatactgcttaataataagaagaaatttgccccctttgaattccaaataagataaaagaagtggctggatgttatcacaagtacaacatttctgtttgggaagtatggaatacttctcagccataaaaaagaatgaaattatattttttgcagcaatatggatggaactggaggccattatcttaagtgatataactcagaaacagaaattcaaagactgcatgttctcacttataagtgagagataagtaatatgtacccatggacatgaaaagtggaatagacattgaagactcattggagattttggagactccagtagacactggaagggtgagagggaagtgagggatgagaaattacctgaaaggtacactgtacactatttgggtgatgggtacactaaatgctgaggtttcaccagcacacaatatatccatgtaacaaaactgcacttgtacccccaagtctatttttaaaagtgattaaaatccatatgttctccccaaccagcatttgccagaacaatggcccccatgcgcctgcagggacttgaccaactattagggcaaaggcctgctacttatctacttccatggtgaagaaaaccacaacagctttggtgagcaagaatgtggaatcctttgaggaacctctgctagggtccaacctgcagaccctgacccagcgatggatgaatgaagtacactgacacacagatattctgctttgccagtccagctgagtgtctgagccacctacagactcccaggagagtactgtaaacagttgcaactcctcgatcagtcagtgagacttgcatttatttagtaaagattaactgacaaaggtcataggaaaacaccattagagggaaattgacattggggacttcctgggtagaaagaaattaagcacccagggtacatcaaaggttagtcttaggaaaacaagttagttagataaactactctacattattttgtatttgtgccttaagctctctagctcctgcaaagagactctggctgccttcagccagacaatcagaagctatgcaaactctcaggctttccaagagagtttgtggctattactataactatcattaatatttttccaactggcctgattgaacccccacaaaactcaacttcagcagagagctggaagcagggtaaggaactgcagttgccattgcaattcattgagaataaagagaaactaaagggacttcaaactcatttgaataaccttagtctctttgtgtcatagaatattcttaaaatacttccaagataaatcatgatatgactcacagagggaaaagatctgtcattttggagaccttaaaatacttgatttttaaaaatgtgtgcattttacttacccttgtgatataaagtactaagatttcacaggggttgtgtaaaaatgtgcattttatattcagagaaaaggctgcaagcacagagatgtcacttcagggattcagtttctagttgttatcttattgtcaatcctttcagcttggtcatctctatatccccacacaccagctcattaaagtaagatatttgctatgttttatgtataatatagagaaaagcagacatcactttccataactcatatgtttctgaaatgatatgtactctttgtaagactcagaaatcatccctctctgcttacctaattaaaaagtagaaaatcaaatatttctggtatgatgctgcttttcaccattttaaatatgactagaaaaggcttgcatgcaccttactgtagaaataaaggtagactacccacatgagaacaggtgattaattcaaagtttgggagtgggaaagctttagagtgagcaaaaaacgggagggaaagcgtgggggaaggcttcaagtatgctctgattgcatgtagttggcaaggggaagttggaagtaggttaactagaagcagagtatcttatgtggttggtttggggaacatattttgctttatttggttggttctaagttggaaacaaggcaaaatagggaagctaacagtcattaatgatatcctgaccatttgggaccaatcactgccaatgatgtggtttggcttcctggactggtggcttcagagattgtgaatcagaattctattgtcatatcatctgaccactattcatttgaatatttatcctctcagccccccattatggtcattctcttacgagagattgaccaattcaggggcagctagaaacccacatcttcaccactgtgatattgccgagtggtctccattacaaactatattgtgaggtcttgactttttgttgttgtgtcagcactgagatgtgaggccagttggactccctgggtccagtggggacctggggaactttcctgtcttacaagaggattgtataaagcaccaatcagcactctgtaaaatgcaccaatcagcactctgtaaaatgcaccaatcagcagattctaaaagtagccaattgcccggaggattgaaaaaagggcattctgataggacaggaacagaatatgggaggggccaataagggaataaaagctggccaccccagccaccagtggcaaccagctcccccttccatgctgtggaagctttgctcttcacaataaaccttgctagtgctcagtttgggtctgtgccatctttaagagctgtaacagtcacagcgaaggtctgtggctttattcatgaagtcagcgagaccatgaacccaccagtaggaaccaactctggacacagtatggcaatgatctctggtgagaacagctgcccagtagaatgtaagacttggcagagtttgtgatggacctgcatcatggcaggtatgaccaaagtgttgcacgttttgtagttccgtgtgcagggtggaatggtgcccagcggctttttctcccctgttgcttggcgagtgagagggagggttacagtgttacaggattcgttcagtgccgcttcaccagctggaaatctctgtggctgcactgacttctgttccggcccttgctcaggcctgccaggttgctctgcccacttggcccagcaggctgcgcttggctcacattactggcccagatcctgtggtcagtgtggctgcgtgctcagctcgtaactggactgggcatgctgcaattggtttccatattgggcgctggtatctagatgaaggggaggtggtggcgccggaatacttggagatgacagcaactacaaagccccaaagggtgttacagcttttgcttggggagtcctgaggtctgagccccccggaaatgttacagttctctctggttcctgctgcctgcagctcagtgaacaggggtgcattacatctcctttgttactgccacccgcagcttcgggagttcccacaaccaacaagaataaggtgtgtggacagcagagagtcagaaaggcagagaagaattttattgagcgacagaaaagctctcaacacaagaggggacctgaagtgggtagacttctgtgtgaaagggggcctgaaagccggcagccatctgtgtagctgagtataggatttttaagggctcagaatggaggagtgcatgctgattgggccgggggtggtcttggaaaaagcaccatttattggttaaaaggcatagaggatgttctcactccggttgtggactctacctagaactggcagttgggttttcaggggtcaggctgtctttggcttaaaggtcgggtttcaaaaacaaaaataatcactagtccctataaaatgttacagaagcagaaattctaattttccaccccagaccaagagaacatataggccacagaccatgaagatctgccttagaatggcaattatcttttttccataaggaaatgtgagatgtagagcctgttttactttgcctgtttcgttgattcaaatatagtgagaagtattagcaataacacagagctaccatgagtagccaagaagaaatctagagaaatatggttattattacttgtaataatagagacaatgtcattaataacttctgccagagttattggtgatgaaactattggtgatggttttcttacagtttttttctatttgtacaattctcactctgattattcacacagtgagtcagtaactcccccaggtagactgcctgaataatcaagggtggccgcatttggaagctccagtctgaggtggaatttccagacttccgtttggaaactggggttgacccactgatattttataatggcctatctgaatccttagaaacttctcctttgaagatttacagaagacaataactttaggccaggctcggtggctcacgcttgtaatcccagcactttgggaggctgaggcaggcggatcacgaggtcaggagatggagaacatcctggctaacacagtgaaaccccatctctattaaaaaaaaaaaaaaaaaaaggccaggcgtggcagcgggtgcctgtagtcccagctactcaggaggctgaggcaggagaatggcgtgaacccaggaggtggaacttgtagtgagctgaggtggcaccactgcactccagcatgggcgacagagcaagaatccatctcaaaaaacaaaaaccaaccaaccaaacaaacaaacaaaaacattaactttagttaaggcttttttttggcataaagttctgttagaattttttctttagtttttctattaccttctttctttgtatgggcctcaaccttaaaatagccaactctagaaagtagagtgccttaacttattcattttcatggggtttccagcagagatgatgaatttctttttttccccaaagcatcccaaattcatgtagtactctaaaagcatacctgctatatgtttactacatggtcttcagctaattgacaagctctagtaagtgtaataaattccattatatgggttgattttacctcagatagaaaatatattctaaagtagagcttaaattagtgataattttcaatatcagttttgaggtatgatccatcaatgaataacattgaatcagagttcacaatgagagccagtctctcatcaatctgagtgaggtacagaaactcccctgacttataaccatcatgaggttcccttcttctggcagggggagaagagtggcagtttaaggaattgcatcagtgaatagtaaagcgagagagagggagtaaaactctcataacaagttgatcagctggttgaaaagtattgcatgctctttgtcagtggttatgtctacactggccagggaatcatgatgtgaggtggggagcctagaaatagtttaaaagaagcatcaacaaatgttgcagtggaagctgttgccttaagacaagggctataagcctttgcagctgggtcaagggtaaggctatggaaaatgatgaatttttgatggtttccatgacattgagttaaaaacaaaaaagcttgtacaagttatccatgcacaattagacaaaatggcatattgtagtcaggggtgcctaattatgaaagagagtgcctaactaccaaaggaagaggctactgaagagccttcttgagttacagaatttatatttgggcccccacaaaagacagtttcttactaaggactcagccaattcataaaaagagattgcaagctcagaaaaatttcacagccattgtctacaatatccagttaaacctagaaatcctctcaattgtcattttgcgaggcatcgaggtgaagtttcgatagtgttctgtctaccaatagaggcaaaataatttcaccctcttaagataacttacaccctaaatactagcctgtcttttgacaaaattataatttatcttttgaaacattatgttctttttctgctatggctgagagcaagtatttacttgctctcaccttctcaccagcttcctcgttctctgaagaaagcagtggagatcatctgatcctgcatatactgcatcaaaactgaatcacaagtgaaatttagaacttttaagtcttgattgaggacttgtggaaagtaagagggggctttagtgagcccctggggtatgactatccgggtatatttgttgtcctctccagatgaaggcaaagtcgttgactgttctggtttggaagcacactgaaaaatgcacagtaaagattcaatatggtcaagcaagtggttttgggcagaattgatgacaggataggtactactaggaagcaaagcaaaacaattttgttgatctttcctgaggtcatgaaaaaagtgtaccagcagaacaagtgtggtgcatgggctattgcagcgtatgagaaagtctttggagataaggtcatcaactacagttttgaagccttcctttgcttctgatttttcaagaaatatcagggaagtttgaccatggtttactaggatacttctgaacttgactaggttctgctccaataatttcccatataaatggatttttttagtttgtagagtgttaggtagagtgttgaggtctttatctggagcgtatgtcaaatatgatgaaggagacaaacatatatccagagacgacatttagaggaaccctcaggagactctgctgtgcatttattatttttctgagacagagtgctgctctgttacccgggctggagtgcagaggtgtgatcttggctcactgcaacctctgcatcccgggttcaggtgatcctcccattttagcctcccaagtagctgggattacaagcatgtgccaccacaccagctaatttttgtatttctttttttttttttttttttttagtagaggcagggtttcaccatgttagccaggctggtcttgaactcctggactcaagtggtccacccacctcagcctcccaaagtgctaggattacaggcgtgagccaccatgcccagctggtgcacttactattataattctatttgaaaattaagttactccccattaaatttgcaagagtgttataatagagcagggagaaatgtttttaagtcaagtacccaaaggttgtagttacagtaggagatagacggaatctgtgggttatttgagatacctgctacttgcttcctatgaggaaaatgttgagcaaaattgccagggtttaatgtagaaagagttagtgcctggctgggcatggtggctcacacctgtaatcccagcactttggggggccaaggcaggcagatcacctgaggtcaggagttctagagcagcctgaccaacatggcaaaaccccatctctactaaaaatacaaaaaaaaaaaaaaaaaaaaaaaaagcagggtatcatggtgcatgcctgtagtcccagttactcaggaggctgaggcaggagaatcacttgaacccaggaagcggttgcagtgaaccgagattgtgccaatgcactgcagcctcagtgacagactaagactccatctcaaaacaaaaaaagaaagaaagaaaagaaagagtagcgcccatattgccaggaattgctgaggttggccacctatatttatggttaattcaccttgaatgttaaattttaaatcaggatattgggtaccttcattgatctaaattaaggggtcttttggtcttatttttactggaaaatcatttttcaggtgtcccttctgttttcaatatctgcaggtgtcctcttctatgggtcgtccactcaactgtttgatctgcagggccgtaaggttattctggatcctgtcttgttattgtcctagggctctgcaaaaatgtcagccaggtgttgaagttcaggtaaagtggctatttcccattctaattttgatctaattattgtctccaatttcaggtttaattccattaacaaagtaggtaaaagagccattattacacttacacttctttaacactcaaatgttgttgaaaggggttttctagtttattctgaaaatctcctataatttcttcttttctttatttacatgattaaattgtggtccattttatttttactagaaatgtttcaagtaaggcttttaggatacattgccctactttttgagcctccttttggccctcaggcttattgtggaaagaaagatgctgtagatctctgtcctggtgaatccaactggcttttgccatcaggatttaatgtctgaggatctacaaacataaatacaagttgatatagttcaggtaaccctgagttgtgtacaactaaaagaatttagaattctgaactcctttgggaaatgcttagtcatagcttttaattcagctcgtgttcaaggtttaaattctactgctgcttgcatatttgggtcattgaagagatggaactttagaggtaaatgacattccgggatcttaggagagtcactgggagaaggtagggggtctggaagaagagggaggagtcaatgaggtgtgaaaggaggatgggggatgaggaagagttgcagagctgaagtcaactggaggagaagccgggggaagatttgctgggcaaatgagttagtttgttgttaagtttgtcatactgttcattagctctggccaaaaaatattttagcggagtaatgtctgaatcagaatttcatttgaaaacttgtgtaccaatcaaaaactgctgcccattgcccctgagaaatattctctcttttctaaggtgtttttcaaatgaacaattttgttcaagtccagtgttctccagattagccactgaaggcctaaattatccttggtatagagatgggtgcaagtgctaggatcgtagcaagggtacatataagaaatgggagattttcctggaggaaaaaaaggaaaagaggatgtacactcagaaaattccatgggagctggcaatggtcagttgaaagtaatatttgtgcactttatgtcttaggcccccaacctgatagttggcaacctccaaatgcagacttgacaacttgtgcccacaggcaaatggaaaaccagaatattccctctgcatcaaatccaacctctcagggccaaaaaaaaaaaaaaaaaagatgaagaaccttatcccattttattggtgactgacaggaaagtttaggaaagtttgtccagatggatgctggtttggtaagaattgcagctcatcagttgtggagcaagctgagacactcttagaggagcaatgcctgtgttctgcactgattctccttctgataacagacaacactttagacatatctcataaaacagaagcacaaaagagaacaaaaaggaatgaaaagaaatggcagtatttttccaaaggtgccaaacaaatgggaattggtagcaaaagctgagtaccaagctgagagtcaataaccaaggatctcaatacaaagagaacagagttgaagcccaattctgttctctcacagacactgtgtcaacacagacttgacaggcctcaagaagcaaggcacaagaggcctccatagataccgcacttgatcagggtccaaagtccatggtgatgagcagttaagaatgtgtctcagtggagcttctaggaaaattacagaaatacagaccaggcatggtggctcatgcctataaacccagcactttgggaggctgaggcaggtggatcacctgaggtcaggagttcgagaccagcctggccaacatggtgaaaccctgtctctgcaaaaaatacaaaaattagacaggtgtggtagcacatgcctgtagtttcagctacttgggaggctgaggcaggagaatctcttgaacctgggaggcagagcccagatctgcagtgagcccagatcgtgctgctgcactccagtctgggcgacagggcaagattcagtctcaaaaaaataaaaaaataaaaaaaaacagaaaattacagaaataaaggagacaacttaatgagaacagaagctatttatttcttgcttgctagagaaagggaggcagtcgctatcatttatgtttgacagagactcaggctgggagaatgggaaagctttatagtgaaaaggggcaaggctttggggtaggtggctatgggcatggagaggcgcaggtaggctaaagagaagcaaggcatctgatgggataggtttggagagagtatttggctttctttaattattactaaactagaagcaggggcaatcttagagaagttggcagtcattgaccaacctctgattgttttcggcaaattgctactgaatttgtggcttgcattcctgaactggctgctgcagagattgtggtttgccttcccaagctggttgctgcagtggttgtgggtcagagttccattgtcgtacgtggtttggccactgtctgttttaatattcagtctctattactaaaaggtatacaaatggctaggcttctcacttcagttcttcatgtacaagctccttttagaggtttctgcactaaactattgtaaaaaaaaaaaaaagaaaaaaaaaaggccaactccatttatccaatgtcaaccttgacgttaagaatgatgaatgtggcagctgtttccttctgttattgatctttttactgacccttcccattgtgctttgtcaatgactgagtatcttccctggaccgctcttatctgaagtcgtcctcatctctcagggattttcagcaccatctgtcagccaggcgctgtgactctgtcgtcagtgaccatttttattgacttttgtctctttctggcctttccatggtgccttggccttaaatgtcctactaatttgctcagtggtgattacagtgctggttttgagagcaccctgttgttttttcttatctaggagaatattttttctctctttatctggaaatattaccttgctggctatgctgacttaggtcattgacatcagatcagtgttctaaatctgatcctagtattcccatctacaatcttcccacacaagccaagggaagagacacacttgattaaaaccttgcactctctttcctatttggctattttttctcctcttggagaaagagtttccccaaaatactatatgaagtgttattttgtaagcctacttaacttagttttatatactgtgcacaaactttacatataatttgaataggctcagttttttgttagtttttttagtttttcaccaaattttatatgacagactatttaagctaaataatttgttgtagttagaagactgttttctcatttacataccaaaatctaccaaaatgaatttattacacttaagaatttttgttaattaccattatcacttctgtaaaataaaataaatctaagaattttatgagcaaagctttttcaagtctactatttagtttagcaattattctaaatatcaatctcaaaattagagtaagggatttccccttttaggaaaagatatcaataattatatagtaaaaatttaaaattaagatacagacatttattctgtgttggatcccaaatatctcattagagaatgatcttctctcattgtctgctattttctaaaatacaggaagatataaagtataaatctgattttttttctaccagaagttaaagaacatagaatatatttggtatgattaactgggagtttgtatttcctctgccatctagaaatattattattttaaatatctgcaatattatttattttaaaagtttttagtttgaaaagacatttctgaaagccccaaatctgtgagcatttgctactacaaaatttttaattgtaagcaattgagagagaaaagtcctcgaatttggccaagcgtggtggctcacgcctgtaatcccagcactttgggaggctgaggtgagcggatcacgaggtcaggagatcgagaccatcctggctaacaggatgaaactccgtctctactgaaaatacaaaaaattggccaggtgtggtggcgggcacctgtagtcccactactcaggaggctgaggcaggagaatggcgtgagcccggtaggcagagcttgcagtgagccgagattgcgccactgcactccagcctaggtgacagagcgagactccatctcaaaaatgaataaataaataaataaaagtccttgaatttatgcaaatgacatagcaatcacttcaactcttaaataatctaaccatcatgagataagagaatggatttttttctactcgtttgtatcttgtctttttgaaagagactacttgttaataatatgcttctgacaaaacaaaaactaaggaaagtgtatgatacaggcctgagtctctctcctcaagttcactttttaaaaataaagtataatcagggataatgtagcctctacttgtaaaggaaggctggctttatgtattaatgaaataggcagcttcttacacgatgtgatttcaacagagccaggaagtatgtcttatctttaaataactccctaaataactccttctaacaccaatatctgaaatgttgtgactgatttctttctgtcctgccctgaagttctttcctgactgcaaagaacagcacattttgaatgtttcaaactgtcatacatgttctctccagaagagtggagtgatgccccaccagacattctaagtcacaggataacatgacatattccatgattgtcagttttaccatgtggcaagtagttaaaaagacgaagtttatagttccaagaacacaaactatgttatggaataggactaaacacaaggagtaaagtagtaccttgtttttgctttaggttactcaccttgctatcagtaattgtattcactgaagtattgaggaacacattaacgttggtttcagatttgttgactttaagttccacatctgaagtatgttggcactttgaccttgcataattcaaagtcatgtctctgcaccactgtttcattctatataaagtgattgacaataatagttatcccacccaagttggacttccatttctgtcaattggccaaactgggtttcctaaaagccttgtagcgctacaaaatatcagaaaattatatcaagtctacttttaagtaaatgtgaagctctcaaggaagccctgatggcaatccagaaatagataaaagcagtacaggagctacagttgcctggggaacagaaactgacctgggttacccagagtttggggtattaacaactactcaggggaaagtaaaagtaggccttggacacataaaatgttgggaaggctgagccagacttcttgcatatagctgagtcacaataggctaagaacatgaatttaggaaggaaagcaaaaaaatctacaagcagtatgaaaaaaaaatctccaacaccttgatacattttaatgaaacatcagatgacaaagaaatatacaaattcttgaaagtgccagagacaaatcagagattcctagagtgaaaagaatgtccaccttttaatggggttatttgtttttttcttgtaaatttgtttaagttccctgtagatgctggatattagacctttgtcagatggatagattgcaaaatttttctcccattctgtagcttgtcttttcactctgatgacagtttcttttgctatagagaagctctctagtttaattagatcccatttgtcaatttttgcttttgttgcattgcttttggcatcttcatcatgaaatatttgcccatacctgtgtcctgaatggtattgactaggttttcttttaggttttttataattttgggttatacatttaagtctttaacccatcttgtgttgatttttctatatggtccattttctgcatatggctagccagagttctcccagcaccatttattaaatagggaatcctttccccattgcttgtttttgtcaggtttcttgaagattagatggctataagtctgtggtcttagttctgggttatcgtttctgttcccttggtctatgtgtctgttcttgtaccagtaccatgctgttttggttactgtagccttatagtatagtttgaagtcaggtagtgtgatgcctccagctttgtgttttttgctcaggattgttgtggctatttgggctttttttttttttttttggttctatgtgaattttaaaatagtttttttaattctctgaagaatatcaatgatagtttaatgggaatagcattgaatctataaattgttttaggcagtacggccattttcatgatattgtttttttcttatccatgggcatgaaatgttttttcattttttggtgtcatctctgatttctttgagcaatgttttgtagctctctttgtagaggtctttcagctccctgattagctgtattcttatgtattttattcttttgtggcaattgtgaatgggagttcatttgtgatttggctcttggcttgcctgttgttggtgtataggaatgctagtaatttttgcacatcgattttgtatcctgagacttcgctgaagttgcttgtcagcttaagaagcttttgggctgagatgatggcattttctagatataggattatgtcatctgcaaacagaaatagtttcccaagaagggagttaaaacaggaacatctcacagccattacagaaattgaagtatttatgtatctcaattaaaaccaaaccatcataaacgtatttctttgaaaaatatcttttttttttttttttgagatggagtctggctctgtcgcccaggctggagtgtagtggcgccatcttggcttactgcaagctccgcctcccaggttcacgccattctcctgcctcagcctcccaaatagctgggactacaggcgcccaccaccacacccggctaattttttgtatttttagtagagccagggtttcaccgtattagccaggatggtctcaatctcctgacctcgtgatctgcccacctcggcctcctgaagtgctgggattacaggcatgagccactgtgcctggccgaaagatatcatttttaatgcctgctaaaatattccactgtatggatataccaaaacttactccttgacttagtaattaaatgtatttatattctgtcttgagtttgcctcccatgtttcaaatatactagtcttctcagttacattgccaaggccattatttatattttgatggtattctcagcaccagctgctgtgatcattgaaatgtattcttgaccttagatgctcattgcacacttgacagattgagaactgactagaggtgcttgttagtatctgtatctcagtggctggggacagctggactcagcttatgtgactcatgcaaagtcagatgatcagtcatagagggaacttggaacttaaaagtgtaaactggaacttacgcttttaaaaattattctatctcacatagtgagaaatctttatgactctttagtctacaaaagggatcagtgaacagtttctgtaaggtgacagatgatatggtatagagtagttccccttatccatggtttcactttctgtggtttcagttaaatgtggtcaactgtggtctggaaatattaaatggaaaattctagaaataatgtatacgtttagattatacgctgttttgagtagtgtccctcctagaacacgaatcaccactttgtctagcatatccatgccttatacgctacctgcccattagtcacttagtagccttctgagttatcagattgactgttgaggtatcacaatgctgtgtttaaggagccctcattttacttaataatggcaccaaagcacaagaatagtgatgctggcttattgttagaattgttctatgttattagtagctattgttgttaatctcttaccgtgcctaatttataaactttattataagtatatatgtaaaggaaacacaatatgtatagtgtcctgtactactgaagatttcaggtgtccactgaggatcttggaaggaatcccctgtggataagggtgcaccactgtaaatatgttcagctttgagggcaacatagtctctgtcacaactgctctacctgcaacagcgccagacaaatctggctaaactttaatccaacaaagttatgagttggtctgagccctcaggctgaaggtcatgtaaactgagcatgcccagatgaaccaagtatgcaaccacaaggggaacagaagtgcccagaccaaggagaagaccaaggagcagggactgacttaagaagcagacgcagtatggaaggatccaggatccaatcaaattgagctctggcatcagcccattgtgggatcgaatcagatcatgactcctggcatcatctcattgcagaattcaatcagatcacacctcattaccctatgcttataaaacccgacccaaacgccagctgggggtgatatattggagcacttcctcctgtctccttaccagtccacttgcaatgaagcttttttttcctcaaaagccagtgccatggtcttggcctccatgtacattaggcagcaagcccattgtttgctcagtaacaccctacctttgcatccctttgtatcgtgaaaacagccacagagacaatgtaaatgacttttatctcatttaaatgaattgtcaacctcagctaaattactacttatcatataaacagaaaatgtaaataaactgattatttctttccatccatgtttttactgtcttcatgtatagcatgtataggattttgaagttaactgtttctgaaaacttacttgcaaatttttcaacactgcaaaaattgcttaaaataatgaagccaagaaaattaagccaggttaaaaacataaaagaagaaaaggaaggagggcaggcaggtaggcatttgttaaaagcttctttccctcagtatactattatttgcgattcagctgtcttgttgtgtttatcagtaagttgattcttggccaggcacagtggcttcacgcctataatcccagcactttgggaggcccaggcacgtggatcacttgaggtcagcagtttgagaccatcctggccaacatggtgaaaccccgtctctactaaaaatacaaaaattagctgggtgtggtggcgggcacctgtaatcccagctactccggaggctgaggcaggagaatcgcttgaacctcgaggcagagcttgcagtgagccgagatctcaccacttgcacttcagcttgggcaacagagtgagactccttcaaaaaaaaagttgattctttttattgtgagtaccgttccattgtataccatttgttagcccattctcttattgatggacagctgggatgtttagatgttagaaataaagatgccttgaactatcataagttttcatgtgaacctatgttttttaattctcttgggattagaactgctgggacagaggatcagtgaaaccttaattttttttttttatttttgagatggagtctctgtcacccaggctgtagtgcagtggcgcgatctcggctcactgcaagctccgcctcccgggttcacgccattctcctgcctcagcctcccgagtagctggaactacaggcacccgcaaccacacccagctaattttttgtatttttagtagagatggggtttcactgtgttagccaggatggtctcgatctcctgacctcgtgatccatccacctcggcctcccaaagtgctgggattacaggcatgagccaccacccccggccgaaaccttaattttatgaaatgttttttatgttccagaccttaactgatgagcttttaaaactaacttctaaatttgaaatgtacatttaattatggaatacgctttaatgtaatcttttgggataatcacctaatattttgccttgagatttttaatataaataacaataaaataaataactaatagtaaatgaataccttctcaatcttcctaaccttggaatatggggacaggatgtgaaaatatcttagagttttgagatcttttcatggttccctcaaggcttttaaaaagagtatttaattgctggcagtggtagctgacgcctgtaatcccagcattttgggagaccgaggcgggtggatcacctgaggtcagaagttcaagaccagcctggtcaacatggtgaaaccccgtctctactaaatatacaaaaattagccaggcgtggtggcgggcgcctgcaatcccagctactcaggaggctgaggcagaattgcttgaacccgggaggcacaggttgcagtgagctgagattgtgccattgcattccagcctgggcaacaagagcgaaatttcattccaaaaaaagagtatttaattgtgttgattttaatgattactgaaattttggctgtttttttgaaactatttcttgtttcctttctctttcccttgtaaataagctgtaagagaaaactgctcaatcacaaaacgtaacagaaggctttcatgtcagtgtccaataggaatgaattttttatggtgacaaggtagggttataatccagatctctggtaggcacatccataaggtgcaaggtgtgtagaaaatagcatcagtttttttggctgggtgcggtggctcacgcctgtaatcctaggattttgggaggctgaggaccgtggatcacctgaggtgtcaagagttcgagaccagcagatatggtgttcttgttctcaaagccgaggtgggtggatcacctgaggccaggagttcaagaccagcttggccaacatggcaaaaccccgtctctactaaaaatacaaaaattagccaggcgtggtggcaggtgcctgtagtcccagttactcaggaggctgaggcaggagaatggcgtgaacccgggaggcggagcttgcagtgagctgagatcctaccactgcacttcagcctgggcacagagtgagattccatctcaaaaaaaaaaaaaaaaaaaagagtctaggatccagagaagtaaactgtattaatgatgtggtcatatccatgccagagcttatttggaaatgcacagaattgattccaagatgttttaataatgcaatctggggtttgcatctcaaagtaatgatccatcaaggatggtctttagagctattttctaactcacatgcttagtggagactcacatcaaaatgccctgttaataggaatcagtagctggtaaactgaagcctaattcaattggtgtcatttccctgcaaattcgtactccatttctgtgctatcaactgaagaccacccacccaaagctattagtatacaatatgatgtgtaacagagctccatgacttctctgtggaataaattatttcactgtagtttttaaaaatatttttcatgtttatactcagagtaaatgagcaatgttacaactattcttctctgtaaattgtcacaccttaagttccttaggatggctcaactctttcacacttccagcatgggaaataattgtttaataaaaataaaacataacaatggattcatgatccaaagaaggcaaaatagaagattttttgttttctatttctcttgactcctcagctaattgtaccaccactaaacctttctttatctcccccacctcacagggttaatctctaatgcttctcaacattttatacctatgtggaaactaccatttaactaaattttgtttgatgtggaaaaaaaatcattctttcaatatttgataattttggatagctaagcacttttgttagatttttattttcttcaagagaaataagatagacgcagtggaaaggattacttctcagtccccaggggttgaatactcacccgaggactcagtgcatttgattcctgatactcatttaagtccccttttcatgcttacttactagtacttcttaaatttgtctccttccaggtgaaataattcaaaacaactcaagaatggaactactgattcattaataaagaacagaaaataaacaagggcaaaacttgagaacataaatacacaaaaacacaaagactcacttaatttttatctcagataaaaaaggaaagtagtttgctgaatttgcctttctactaagaagtctttgctttcacttggttgggagggtacttaacatgaagaagcaggaattcctggaaaacaggccccttctaccctaatgtgttttctgtggggttgttcagttattgtccctaagcagaggtaactgggaaatagccttgggctgtaattttcccattttaccttaagcaatatcataactagcaatgtgtgacacccaggaggtttgttttctagataacactctctttacaatataagggctctttgagagagttaatataataaatcctcagagtaaagtctaggatactctttagaaattaaatattacttgaaacatatgaaagccattcagcaggtgacagagctatttacaaatagattaaacatctttcaagtaaattattataacattcattaatgttgttagtgtttatgcactaaaacatagcccaaaataacatattttatcctcatattgtaacacaatttatgttacacttgaacaaaaatccctcaatgtgcagctgattttaaatccatcatcagttctactagtcaaaagtggagaatctttttgcatttgtacctctggtagccaacgtaatgtatcttctctccatgtttctttatccattcattaatgtgctgttttcacattgcttcgttttgaaattgtccatggcccagctgaaccaagcagaaagatttcccaggctggttgcattgtatttcaccttctgttgtcaattcttttggtctcctaagaataaaatcctttggtctcataagaataaaatgagttttgttttcctttgagcatgtagaatatttttggttattgttcaaaagtgaagccacaaatcagaaaatgtttttcttcttcgtttatttgttcctctagcaatgtatatttcatatatgtgagtgcttaggtctaaatttcaggtctacattcggcacagcatcttcatggacagctaatgagattgcagatggtaaagcagaacatgtgtggtcatgggataaactactccaaatatcttattaaacccttaacactcccctctctcacaggcttcctttgcataaacattttaaattacatttttataaagacatagataaatgaatacctccactgtaatttttcttaaaatttagcatgattatctcctttgaagaatagaatggtcctttaatcaaccaattaaaattgtataacccaccggaagaattcatatattatgtttaataattagtcataaaccatatgtctgggactatttaatattgactttagctccatgtatattatttccatctacttttttattttagtaggttaatagtatgagtatgaatatattaatttctaagtggaaagagatgtactttattaagctttggattgtcaaggagaggaatggttaaatatgactaaggtccatttatatttaactctgctatttttttctggaattgacagtataggtgaatgcatgctcgtattgtactttctcctttgaaataatgaagaagccagacaaaaggattattgctcacagaagagaatagaaaaaaggaagagaaccagggaaagaaggacccaatccactttctctaaaattattcatgtttgagacaatgactgatttcatgagtatcttcttacctctctatgtctttttctggcatattttaaggttgatttttgaactgcctttataaatgttttctaaggtttcaatgaaggtaaatatgcctttgcaaactatttctcaggctatgaaccatgagtgtgtgggtcagtgagtggcaatgatgacatgccacacttgtgaagaaataaatgatgaaaggttaaatgctttttgccttagatcaggaagaagaggttgttcacttgtttagaatgaactctctgagattctttatctgctcagcttgtagccattgtttctgcagccaccagagacccagacagaagcgcagcagcaggagatccacctgcatgggtcagattgcagatgtggcttcagtgacatgaccacagtgtgaaagttccctggggggcacacagcatgcttagaaaacacacacacacacggaggtcattgcctttattgggtccagggcattatataaacagggagctttaaattgatgggcttaaagcaagcaggcactagtactaggaagtcacattgtgactgaaaagtgtttaaatggtcgtttagaggaagcagcaggaaagctgggagcccatcctgctaggagacagagatgcctccaggtttttatttctggtcaccacctggagccatttgggggtatagtacaggaaactgcatcaagggtgactgaaccctgcttctggtttgagaaagttaaacacatatttaaaaatggatgctaaggcaacataaaactttaagcgctcactgcagcacatttacctcttttatttaccattgtattggaggttctagccaagataagataattaaacgaagaataaagtaaaggcattcagattggaaaggaagaggtaaaattagctctacttgcagatgacattacctttatatagaaaaccccaacaatgccactaaaaaaaattattggaactaataaacaagttcagcctgaccgcaaggtacaagatcaatatacaaaaattgtaggggcccggccctgcacagcgccctggggaagctggtttgaaagctctggagcgaccccagtgccgggtaaaggacaagatttgcccagacggaagggaacttggggagaggtggccgtgagagtgtgggatgaaaatgtttcgggcagagcggtcggaactcacctgaggaaagcatggggggaggagtcattaatatgaatgagtggcagggacagggcgtccttgcagcgccctcggtgttggaagggaagaccgtgcagcgcgatggggatcagggcggcgggccgcagccggggtggggttgggcgccggtcagggtgccttgaagcagattctgtcctcaggagctgcagttcttcctcctccgccctcaccggcgggcgaccttaggcagggagtgaaatgcaacgggagccctggagggagggtgaagccgcgcgtgcaggaggaacctccgattggcgagttcaggttccccagctgcggaggtggggaaccctgtgtggcagcctgctgagcggctgcgtgctccgcggttggaggggggaagctctagcccccctcctctttttcagccgagaaaccgctagttacccccttatgcaaccaagactgtaataaccctgtcacctttcacggccctccgggtctgcgcctatcctctgaagattcactcatccaccccgaggcctgttttcctcacctgttgtccctctggcagaacttaggccccttggagaccagccagcatctatctgcccgctgttcccacccaccacactccctccgcagttctatcccagctccttaaatggttggagtccaaacctcagaccatgacagcacacgggcctggactccggtatggccctggacaagttccttaatctctctgagcctcagctttcttccacgtgaagcagcggtaacattgttattaggagcctccgggccccagcacaccgacatacatacaagtggatatccatcctgcctgtgaggagtcgtctttactttgggttgtttcttgtccacagaggtccacactttattttcctggaggcaccagcagagtcactgatgcacccctgcatccagcatgtttaagggagacagtctggggagggcaggaagagcctagagggtcccctagtgattagggctgtgatggggatgttactggaaaagggtccctatccagaccccaagagagggttcttggacctcctgcaagaaggaatttggggcaagtccataaagtgaaagcaagcttattaagaaagtaaaggaatgaaagaatgtttactccataggcagagcagcggcatgagctgctcgactgactatacttacagttatttcttgatcatatgctaaacaaagggtggattattcatgagttttccgggaaaggggtgggcaattcctgcaactgagggttcctaccctttttagaccctatagggtaacttcctgatgttgccatggcatttgtagactgtcctggcactggcaggagtgtcatttagcatggaaatgcattataattagcatataatgagcagtgaggatgaccagaggtcactttcgtcaccatcttggttttggctggctcctttactgcatcctgttttatcagcaaggtctttgtgacctgtatcttgtgcggactttctatctcatcctgacttagaatgcctaagctagtgggaatgcagcctcgcaggtctcagccttattttacccagcccctattcaagatggaatcgctctcgttcgatcacctctgacaggggcagtgtacattcacatcttggcctttgctgcctcatccttccagatctttcagatgcttgccctctggcattctaggataggaagactgcttccaaagtgacgcaggaattttctcggacacttttccaactgcagacttctggctggtgatgcccctgcccatgcctagctctgccccaggcaggaggtgccctgcccacttgggcttgcactctggtggggatcctgcagccactgagactgcatgctcagccccagtaggagggtgtgtgtgatcaagtgagtgcctcatcttgccagcaactccaagtgctggcacaagagcaggctccctttggggcctgcagctggatcaggcctgtcggaagtgactccaggggtgaactctggcatgcagatgaagggaacttggtggtgcccaaacaggaaagcactcgactctgaagccccagaggggatgttacagccatgctaacagctcttttagtcccacggtcagcagcctgacaaacaggggcatgttaacaatgaatggggggtgtgttaacaactctgtcagtcctgttgcctgctcctaccagaggctccctggctggcctggccctgcactgcctctcatggcaaggggctgccactgggcacagatagtgggggaggggtggagggctatggtgttactgccttcttcataccctttgctgacaatggaagggtgaaaagggtggagaagagttttatgaagcaatgaaacagctctcagcggagaggggatgcgagggtggtccctgacctgaagtccggtggtctctctcccagcgtggctgggtccggggcttttatgggctcagaagtggggactgcatgctgattggtttacgagtatgcaaaaaaggctaaaacaaaggaaccattcaaaggtggcatgacagtgtagaaaaccacttagggaagggtagatatatgtaaagtaagtgaagggtggggatcagtcagaggaaagtgcaccaacaggaagagatgttctcagctcggtccatggatttatacaagacttgtagcttagctttcgggctttaaactgcctttggtttgaaagttggatttcattggggacatgccactatctgcctaggggcttgtctgactcctgccactattaaaagtactaaatcagtgcatctagcctgagggctgcccctagtctacccagcagaggtttttgttttgttttgtttttcttttgttttaattaaaattttaattaaaagggactaatatagagggtttttaaaaaattaccatatgtgttgagtatttatgctatgccaagcacttcgcatatattttctcatttaatcctctaaatagcgaggttgattgccttatctccaatctatagatgagaaagctgagactcagagaaattaagaaacccacatgaggtcatgttgtatgtaagttagtttttgctgcatcataaaccacccgtttatgatttcaaacaggtaatacttgtttctcaataacgggaagggggctggatggctaaggggcctcatattttagggacaggaggagctcatcgtcagctgggtaatgggaatgcgaccacaagtctcattatccaggagagcttgaacataggggttgagtttcaaaagcagcacaagggcagcaacacaagaacttcccatgtctcacttatgtcatatttgctattctcccattggccaaagcaggtcacaagggcatggccagccagtatggaaggggacaaccaaaggggtggacacagggagtgacaattgctgccattttccccaacaaagaatctaccatccatagcttctaagtgtacaactggaaatcaaaactaagtttgtcttacttgaaagttcaaacctgtcttggagctactgcctggggtctaggaatccaaaacattccacacattgcctaagtcaacaacctgttgcgcacacacaccagcaactgttttgcaaaagtatgtggatctggttgtcattgataaaatgcaaattaatttagatgtattattcaattcatagtataattttgttgtattttcaaatcaacagatatttacgtcatttcaaagcagctcttcacaaattattcattagttacaaaaggaagtcacttcacagtggaaaaatctggcaggcgccaccttaatcaagtaaccaaaatgaacatcatcagtaataggacaaattgcaatcgtgtgcctcctgatagtctagcaagaagaacacagcatcacttctatgatgctcctgccaataatacataattggaatctaatcctaaagcaacaaattcaaattaaggaaaattctacaaaataattggcctgtaatagaagtgtaaagtcatgaaagttaaggaaagactgaagaactgttccagactgaagatgaaagagacgtgagaaataagtgcagtggtgattctgaactggatcctgacttggcaaaacttgaataggtctgttggctggatggtagaaatctattaatgttgatttcctgattttgctagctatattacaatttcattgcattcagtccttgtttatagaagacatacagtatgtaggggttataaggagtcaggtcaggaactttcaaatcatttagcaaaacaaaagttctttgtactttaattccaagacttctataaatttgagaatattttaaaaatactttaaaaaactcctttaaagtctctcaacatgctgtcctattaataatagatttctaaatttgtttttatttttatcaaagttttgtgtgcccatagtttgaagtattaaatctttttttatttattaaaacattttttaatgtccattcagaggtaatgaagtgttagtttttttttttttttgagacagagtctcgctgtgtcacccaggctggaatgcaatggtgcaatcttggctcactgcatcctctgtctcccaggttcaagcaattctcctgcctcagccacccgagtaggtgtgattacaggcgcccgccatcgtgcccagctaatttttgtatttttagtagagacagggtttcaccatgttagtcaagctggtctcgaacccctgtcctcaggtgatccacccgctttggcctcccaaagtgctgggattacaggtgtgagccactttgcctggcttgaagtgttagttttgtctttttttttttttttaaagaaaagtagttcccttatctccactttccccctttcctgcacctcagaggcaactgctttcagctgattactttgacaggtatgaccttatttccacataattgcttatgtcattatttttttctttttgagctagggtcttgctctgttgcccaggagtgcagtggcgcacttgtagctcactacaaccttgaactcctgggctcaaatgatcctctggcctcagtctcctgataagctgggactacaggtacatgctaccatgcctggctaatttgttttcgcagagacaaggtctcactatgttgcttgggctgacctctaacttctaggctcaagtgatcctcctgcctcggcctcccaaagtgttggaatacaggcgttgaaatcaagtttagcctaaagttgcctccttatatatttaagtttggcctaaaagtttgtctgtatattgtgacaagtggaggtgtaaacagactacacttgtgccaatcactgagttttggccaatcaaatgtagccaactgttcaaaccatgttcagataaggcaaatgccaagctgtagccaaatccagctgtttctgtacctcacttccattttctgtccataaaccttccaccgcgtgactgcgctggagtgtccaagcctactctgcctgggaaggctgcccgattcttgaactgtttgttgttcaattaaactcctttaaattaaaaaaaaattgtatttctgtactctagcaatgaacacttcaaattaagacaattccattgataatcgcatcaaaaaataaaatgcttagaaattaattattcaaaaagagcaaaagttgtaccctaaaactacaaaacatacttgaaagaaggttaaaaaaaaaaaggagtaaataaatgacaagacaccaatgttcagagattgggagacagacattattaagatggctttccaaattgatatacagtcaccacatctctatagaaatcccaacagccttttctgtggaaattgacaagcccatccaaaaattcatgtggaaatgcaagggactcctgatagtcaaagtaatctcaaaagtgaagagcaaatttggagtatgcacacttctctatttcaaaatttactacaaagctatggtaataattacagacttgtactggcataaggatagacatatagaccaatgggatacagctaagagtctagaaatcaatgtttacatgaatagtcagttgattttcaaccagaatgccaaggctgttcaatggaaataatagtcttttcaacaaatggtgctgggaaaactggatgtcacatgctaactactgaaactggaccctttcttcatattttatacaaaaagttacctcaaaaatatatcatatactaaaatttaatagataaaattataaaactcttagaagagagcataggggaaaaaatcttcttgactttagctttcttagatatgacaccaaaagcacaagcaacaacagaagaaaatagataagttggacttcctataatttatacatatatgaatatatcacattgtatcccataaatacacacagtcattatttgtcaattgaattttttttttaagtaaaaaaaaattttttttgaggtggagtcttactctgtcacccgggctagagttcagtggtgtgatcttggctctctgcaatctctgcctcctgggttcaagaattttcatgcctcagcctccccagtagctgagattacaggtatgcaccaccacaccaggttaatttttgtatttttagtagagatggggtttcgccatgttggccaggtttgtctcggacccctgacatcaggtgatctgcccaccttggcctccctaaatgctaggattacaggcctgagccactgcgcctggccagaatttttgtagttccaaagatgctaccaagaaactgaaaagacgacacacagaatgagagaaaatatttgcaaatcatatatctgataagagattatatccagaatgtataaagaacacttaccactcaataataaaaatacaaataacccagtttaaaaatgagcaatgaatgtgactaaagatttttccaaagattggcctgtgtgctcataggaagatgatcaacattatttgtcattagaacaatataaatcaaaaccacaaaaaaggctgggcatggtggctcacacctgtaatcccagcactttgggaggctgacatgggcagatcacttgaggtcaggagttcgagacaagtctggccaacatggcaaaaccctgtctctactaaaaatactagctaaaaattagctagctaaaaaattagctagctaaaaattagctaggcatggtggtaggtgcctgtaatcccaggtacttgggaggctgaattttacttttagatggataaaatgtacattatataaactatatgtcaatacagctatgtatttttttaaagtacaaactatttttttaaatacaaaaacattacatagagtgaactctatggcatagctgccatactgaaggaattatactgtgtttaaaaacctgattaaaaattaagtttttaaaaaatggggtcattaaattttattttaaggttttaacagttctttacccaagccaaacattttatctacagttgcccaaggaaatgcagtaagcgggttacttaatttcctccctgtggcaatccttggctctcgcccttcttaacactttattaatgcaagtcagcaactgctagttttacatcttatctttcatcaatgtttaagagatagcaagtctagggctcattatgatctgctaatatagttcttaacaagacacttagcttccatagttatttgccagtgaagcaagaaagtggtaccacttcatcattattctgattttattggagagagtgaatgtgtgagtttactgagggaagcagcccaaggaagtgggatggtacaaattctacaacagagatcacccatagacaaggagtggacccatgaaacttaaagatgtagcgatttagggagtgactttacatcctaggattaatgtctttgggggtttatgattaatatttagttccttgttgccatgtaacagaagatgtaaatgggttgctgtggtgagtcatattataattttggtttttttttttgagacggagtcttgctctgtctcctatgctaaagtgcagcagcgtgattttggctcactgcaacctccgcctccctggttcaagtgattctcttgcctcagcctcccgagtagctgggactacaggtgcccaccaccacgcccggctaatttttgtatttttggtagagacggggtttcaccatattggccaggctggtcttgaactcctgacctcgtgatctgcccccctcggcctcccaaagtgctgggattacaggcgtgagccaccacgcccagccaattttggttttaattagaaactagataggatgcataccaaatatatattatgacgtgtccccaccccctgccaaatagacacatatacattgtctccttatcttttctccaattacagtatctatttcactcacaacttttatgcaaaatcatgaaataaaaataattttaaaaattattaatcttcaaaatcttaaaaattattaatcaaatggataaatttgatatatgtgatattatttgtctttggtaattttgtaaagacttttaaactgtttttaacattcaaaaggaaagacacatctctctcttttaatgtagagggtcagtcttggttatttacagcatacatgggaggccttatttgattctccaatccctggaaaaatagagttgaatgctcatttgatcctattccacatgctactggtttccctcctgttcaccctgctccagccttgaggatgttcttgccgaaatatcaccatccaaagctctttctctatcaggcttttgcatttgctgttcccttttccacatcttctcaaggctggatcttctttagttttcagcaaaatgtgaactctgtgaagaggcctccctgaccactcaattagccactgccccatgactagttttttttttttttaactttcttaaagtgctttaacttcctcaagcccttattattattctttgagtgcattttgattatttgtttcttgtttatcatctagaagtagatgacaacttcatgacaacaggaacataatcctcatgagggcaggcattttactagtattgttcacgattactttcccactcccatgtcaaattctgtgctgtaataggcattcaataaataatggaatgaatgaatgacagacaaatgtcacacatcatgccacctgatgttataacatccaatgttgataaccgaacagaagcaaaattaaaggccatgagatattggaatggtcacactgattaaaggctttgtgggctgcacctcattgcacacatttatcaatgactgaattaaggtgatatttagcagtttgatattacctatgaaaacaaaccaaatggatgtagcatgctttctttttttgaaacatatttaataattgatttcaatcattttcaatctgaagttttaatatacttttaacaacagatttcatagtttggttttgtttttcttgtttgtttagtgactcgtttacttgagcattaatattaagccagttctttgtgtagttatatatagaagtagccatcaactcccaagcaccaactccaggccagttcgaatacggaggactcacttgaattcctgcatctcaatgatggtacagcctggagcccttctgtcctccataccaataggcagttacagctgatttggttgtttggcagcgaatctctgtcctgctgccttcaagctgccatttcatttcttcagtatggagacaggaaatgtggcttaccatcagcaacaagctagtagtaatcatcctcatggaagacacaaaaacgtttgtcaagagggtccaaagtttgtagctggtgagaatgtacaggaagagagggaggaagagagggagggagggtggaagagacagagggagggtggaagaaagagaggaaggaaggaaagagggagggagtaatagagtaagagagagagcctgagaaagatagaggtggactccacacataccagcaaaacaaactcatgaggtagaactttttagcatttaagctttgaccagcatccagatgattttcttttcttttctttttttttttgagacacagtcttgggccatctcccaggctggagtgcaatggcgcgatcttggctcactgcaaccctctcctcctgggttcaagcgattctcctgcctcagcctcccaagtagctgggattacaggtgcctgccaccaagcctggccaccacgccatcacttctccatgttggccagcctggtctcgaactcctgacctcaggttatccacccgcctcagccttccaaagtgctgggattacaggcgtgagccaccgcacccggcctcaaatgattttgaaatgtactcagcaatgcaaaactatcgtcccgaattcttaatttggtgcattttgcttaaaggaatgtaagttgacaaatggtatgtgtaatttcccctgtggtttccctcttcagagtctgtgctccctgcattgaataatgagatgtaagtttaggaaatgcctccatggtgttcattatactttgtgtattttccctgagacaggaaacagaggactgtctgtcaaagaaagcaatttttataaattcacagccaatggggaatattcctttcattttttttagctaaatctgtgatttaacaagtgtagagaagtgtttgtcagcaaggagattgaaatcattatgtctttctctacctgttgataatgatattgcaagtgggaagtcgcaaatatattggcatcaatagcaacatggcaagcagatgaagctccaaaactcgtcacccactttgaagccaaataaaaagcccatttttctttctagttattaatgatgtgaaactacagactgtaactgcaaatgatcattggcaagggcaacataaaagttataaatttaggctttgaaaacaaataaaacttgaagcaatcctctgtattttattcctaaattaaagatttcctctttttttttgagtgaaagaacttatacttaagcatggaaatgagaactaaatcatttgctgaaacaattgtctgagagttacttaattcaaaaccactcttgtcatatgaaataaagcagaacttgattagcatgtaataaaaggctattactttaacagacagtaaatatattgctgattcctgaagtctctggccccattttctcttcagaaaactatttcaactgatagcattctctcctttcattgaagtcctatagtaattaaaatcagttatttaattatatactgccttgatatacagagttcaaagtttgtaggactattgctaatcatctaaatcaggagtctggtaaactatggcccaaataattaaacttggccataaccatttttttcttttttttttttttttttttgagatggagtcttgctctgttgcccaggctggagtgcagtggccctatctgggctcactgcaagctccgcctcccaggttcacaccattctcctgcctcagcctccagagtagctgggactacaggcgcccgccaccacgcctggctaattcttttgtatttttagcagagacagtgtttcaccgtgttagccaggatggtctcgaactcctgacctcgtgatccacccacctcggcctcccaaagtgctgggattacaggcgtgagccactgctcccggcccttggccatacccatttttttacattttatctatgattgctttcctgtgattgagttgaacagctgtgcagagacattacagcctctagaacaaaagtaaatttactatctggccctttgttgaaatagaccttaagattgtcacgggaaaaaattgaatctcctactcagaggatattgtttcacaagtgtggtccctaaaatggagcagggaaccctcttggggcctgcaccccctccattccaccaccctgcacccccatgcatggaaataaaggaaaatattgagttccttcaagggaaattccaggcacctagctagccctgagaagcaagcaacttgataagcaagaaagtaatcacagcttaaaacaacagccaaggaagttctagccataagatatttgaaactaaaggtaacattttaacatatgtccctgagttgtttttcagaaacccagactccctaccgagcagatccgctggcgggtagaacacagataagggggagctgaggactgaactccgaactccgtttgtccttggttctaaatttattcttgagggacctggaggaagccgtgcccacgtgccagagctaataatcttttctgctgaccccaaatgtttaaacaaactcttttttcatcaattgcaaaacagtctttgaatatacctatgaccggtaatctcctacctcaaactatcccacctttttaggccaaaccaatgtatcagttcacaatgttgttgtaacttctgttttcctgaaatttacccctgcctttaaaacccttacttgtggccgggcgcagtggctgacgcctgtaatcccagcactttgggaggccgaggtgggcggatcacgaggtcagaagatcgagaccaacctggctaacacggtgaaacctcgtctctactaaaaatacaaaaaattagctgggcgtggtggcgggcgcctgtagtcccagctactcgggaggctgaggcaggagaatggcgtgaacccgggaggcggagcttacagtgagcggagatcgcgccactgcagtccagcctgggtggcagagccagactccatctcaaacaaaacaaaacaaaacaaactcttactcgcaagccatcaggaggtcaggtgtaaagcaggagctgctatattctccttgcttggcaccctgcaaataaacacctcttttctcctgctgcaaaccttggtgtgggtgtttggcctgactgcgctgggcaggcagacccagcttaggagtgaaaacatcccagaccagcagcatgagcaccacctagcaagttgtcagaaatataaattccaggctgggcagagtggctcacacctgtaatcctagcactttgggaggccgaagctggtggatcacctgaggtcaggaagtcaagaccagcctggccaacatgatgaaaccccgtctctgctaaaaaaatacaaaaattagccagggtggtggcgggctcctgtaatcccagctacaagggagactgaggcaggagaatcgcttcaacccaggaggtggaggttgcagtgagcccctgagatcatgccattgtgctgcagcttcagcaacaagagcgaaattttgtctcaaaaaaaaaagaaaaaaagaaaaaaagaagactgaccatgttgagaggtgaagccagctgggcttctggggcaggtggggacttggagaacttttatgtctagctaaaggattgcaaatgcaccaatcagcactctgtaaaatggaccaatcagcaggatgtgggcagggccaaataagggactaaaagctggccacccaagctagcgtcagcaactcgcttgggtttccatccaggctgtggaagctttgttcttttgctccccacagtaaatcttgctgctgctcactctttgggtccgccccacctttaagagctgtagcactcgccacgaaagtctgtggcttcactcctgaagtccgtgagatcacgagcccatgggaaggaggaaactcctgacacaccatctttaagggctgtaacactcacggcgaggttggctgcttcattcttgaagtcagcaagacgaagaacccaccacaaggaataaattccggacacaatgttacctgtcatttaaaatgtagccacttctcctccctttcctggtctctccttgttcctattggaagttacctctaacacttccatttgtttaatatcataaagttgcaagaaacgtacagagagagaaaaaggttctaacttttcttaagataatatgggtgtatatatacgcaaatatatatataatgcttgtataaattaacatttattatcttctatgatatgataaggcatatcaccaagtaatctggaatatcaaaatatcagcatcagctctctctgtttcaatacgtataaactaggtagttcactaggaactttgaatacattagctctgaccttttcaacagttctatggaaaaaaaatagttatctccttttaacagaggaagaaaattgatttttcagggtatttccactcttacctcagtttcctcatatgtaatgtgggattgactcagtcatctgcttgaaagaagacaggcaaatctggtcctctgaagagggaaaggggagatgagcgaaaatgaacagaggaagccaaaaaaaaaaaaaaaaaaaacacacacacaagcacacaccaaaaataaggaggagacccattttaacaggcatataacaagtcagttttatctctttatttttttattttgtatttttttttgagactgagtctcaccctgtcacccaggctggagtgcagtggcacaatcttggctcactgcaacctccacctcccgggcttaaaggattcccttgactcagcctccagagtagctgggattacaagtgtgcaccaccatgcctggctaagtttttgtatttttagtagaaagggagtttcaccaagttggcaaggcttgtcttgaactcctgacctcaagtgatctgcctgtgtcggactcccaaattgctgggattatgggcgtgagccagtgtgtctggcagagttttatcttcaaataaaatatttttttaagaaagctgaaagcctcacagaagatatgtccttgagggaaaaatttcaaacccttgacttgcttgtcatttggtagtttttgtaactgagtctcagtgagctacggttttcgtagctctacagacacaaagcaaaagggtggtcataaagctgcctttcagcagacatctgcaggcatggctgggtgtgtgccacacactggccagctcagaacatgtccttgtcactgtgaagcttaatgagatgcacagtctatgacctgtcttaaagcaaagtgaagacataagcaaaacagaagccaccctgatatttcagagtgggatatctgttaagagatgatctcattcagattgatttttaatattaattgaattgcaggcttgccacaatatggtggaatactaacaaaacataaaagccgcagtagccgtggggtgtgacgtcagcaagtgataaaatgagactttctggatctcggcccctcacagaaacatcaatttgaacaaatcttcacacacaaaaatcctttcacaagagctgaggaatccacatgagagatcacagcatgttgagtgtaacatagaaataaaacccaagctctgggaccaccaccccagctctaggccagcccctgcagaccaaggtccaggctggcctccagggcccaaggctccaggcccaccccagaaccaggcttggccccatgaactcatatatatacagcctgagtctgagaaaaaaaggtaatttttcttcacagtgaaaattgcagccaaagcaacatcttgcattggatatatatgtctttctctagggcctggacatgcagaaatgtgtaatattcatagagaattgtctccagcaatgaagaggaatatgtgggaacatttaattttttacaacaaagttacaatctgggaaacacactttagtctgatgcaaactcaatcaatgctagtattggctactcagaataacctacaatttaatttatgtcagtttttataatcatccctgaaaatcagaactcataattacgatgttgtgtataattgcaaatgagaattttagaaatcatttaaaagccaaaaggtgtttatgaaggtaaaaatctcaaatttcaaacaaaaccttgtgatttgagataaaagatctaatagcatcataacagattcatatgcaaatttaatacaaatgcaacaggaatttagctggaagagaagatgctgcattttgaacaactgtgttgagtgactcaaaacatggctcctgtaaggaggaagatctcatgctggaaatgcacgtgatgaatgaataaaatatttttacaaagactatattttctttttgttttgagactgagtttcactcttgttgcccaggctggagtgcagtggtgagatctcgtctcactgcagcctctgcctcccgggttcaagtgattctcctacctcagcctccagagtagctgggattacaggcacccctgaggtcaggagttttttgtttttggttttttgtttttgagacagagtctcattctgtcacccaggctggagtgccctggctcaatctcggctcactacaacctctgcctcctgggttgaagtgactgtcctgccatagcctcctgagtagctgagattacaggtacccgccaccacgaccggctaatttttgtattttcagtagagacagggtttcaccatattggcgaggctggtcttgaactcctgacctcaggtgatccacccgcctcagtctcccaaagtgctgggattataggcgtgagccaccgcgcccaacaaaagactatgctttcaggaatcatttcttttttttttttctgagacagagtctcactgtgtcacccagtctggagtgcagtggcgcaatctcggctcactgcaaggtccacctcccaggttcacaccattctcctgcctcagcctcctgagtagctgggactacaggcacccaccactatgcccggctaatttttttttatttttagtagagacggggtttcaccatgttagccaggatggtctcgatctgacctcgtgatctgcccgccttgtcctctcaaagtgctgggattataggcatgagccactgcgcccagcaaaagactatatactttcaggaatcatttccttttgtttttttttttcctttgagatgaagtctcactgtgtcacccaggctggagtgcagtggtgcgatctgggctcactgcaagctccgcctcccaggttcacgccattctcctgcctcagcctcccaagtagctgggactacaggcgcccaccaccacacccagctaattttttgtatttttagtagaaacggagtttcactgtgttagccaagatggtctcgatctcctgacctcgtgacccacccacctcggcctcccaaagtgctgggattacaggcatgagtcaccacccccggccgaaaccttaattttatgaaatgttttttatgttccagaccttaactgatgagcttttaaaactaacttctaaatttgaaatgtatatttaattatggaatacgctttaatgtaatcttttgggataatcacctaatattttgccttggcattaggcatggagcatttgtctgggtgatcacatggaaggccctgcctcagtttacctccctcattgacctgcttgttgactaaattatcataacttgatcacaattcctttgaagctgcctgaatcaaagccactgatctgcagataaaatcaaaatacacattcagtgttacacacaaagtaacattgccttatatactgtatctacactttattgagaactggaaattccataaagatggagaggcattactgaaggcaagcaagcaaaactctagcatgcagtcagactcatggcaggaattaggcatgatctaccttgtcctcacccttggggcactgcctgcatgtctgtaggcctcggccatgcccagctcctgtggctgcctggaaagtgtgggtttggccagttgctgccatcactactcctcaataggtcctggatctcagaatttgcctggtagtcctgggcccacctgctgatgttcaggataaagggagtggggagaaggggtcattctgcttccttcacgtggaagtgcaggtgttagttttgggggactggacagcaaagagcatggttccttgactcctgggtcatggggtgtctggccacttccacatcgttgccactcactcctagtgatacaccaggcaccagaggctccactcctgaggcacatgccccggctgcctcaacactggcccttccccccaccttggatgagctcctgttgcttcagcatgagcagggctcactctttcactctgcagcaggcctaggctgtgctggcttctgagatgccccagggcacctgctgggaagtggggtgtatgtgcgtgaggcgccagtgttggtccattctcgctgggcagccttattttcccagctttttccttgtgccgccctcagccttttgtctctcatgacttccctttcaggtcacaccactttgctgcttgacccttgagtgttagcaacccttccctgctctgggactcagtttacctttttttggtctagaggggcaggacaggtgatttcttcccagcttgactccagatcaatagcttgccctcccctggtgacagcagagagatctgtgaatcactgcccaccctcaccccactcctgccccttggcatactccccgccccaggtcttcccaggtcacctgcttttaggctccaccacacccctgcaggtcagcctctcccagcagccttcccgtagactccttctcctctctccccgtctctttcctgtagaggctttggagcccatcagcccgaggaccaggactccaccgccctgcacccctcttgcgccaggatggccccaaacttcggcagatgctctggctgtaaaacttggaccagcaccaggtaccccaggcagggccctagttctgctgtcctgctctgaaggccatgttcggtggctggcctagcctgatgggaacatgtacagtcaggaaatctctccacagctccaggcccaggtaaatggttctcaatactctggcccaagggactggtcctttgaggtcaggagcacatctcagcttcaaggaaagctgaaaaacatgcaagactctattgccaggagaatttatttttattttttctttgtgttattattattttttctttatctgcctttttttttctttttttttttttttgagatggagcccaggcgggagtgcaggggcatgatcttggctcactgcaacctccgcctcctgggttcaagtgattctgttgcctcagcctccccaggtagctgagactacaggcgtgtgccaccaagcccaattaattttttttctttttttttttttttagcaaagatggggtttcaccatgttggccaggctggtctcaaactcttgacctcaggtgacctgcctgcctcggcctcccaaagtgctgggattacaggtgtgagccacctcgcctggccctgggccaataattttttaataactcctaccataatatttttgtttgttatttatttgataaatatgatagactaaaaataaattagcaaggccgggtgcggtggctcatgcctgtaatcccagcactttgggaggccaaggcaggcagatcacctgagatcaggagtttgagaccagcttggccaacagggtactaaaaatacaaaaattagccaggcgtggtggcaggtgcctgtaatcccggctacttgggaagctgaggcaggggaatcacttgaacccaggaggcggttctgtttgcaagtatagttgtaactgcaacccaaaatgtcttagaaacttgctatttgaagtattgtcatcacctgggatcttgctagaatctgcatttgacaacattctcaggcaattttaatgatcattaggtttgaaaaacactgccttaaaacaaaggaaagaatggcaggcaagtttcaattctaagcatgctatattgtatgttcttgggcaaattccactaagtctgaattttaaaacagttaactatgggtagtaatgaatgaagtgtcaccttgtaaagctactttgagaaatccaagtgttggcaaaccctttgcaaaaataaagttgctgaacatattctaatacagttatgttgggctcctgttcttatgaggcagagaaaattatgctttaatcagagcttctaagtcacaatcactggaatctattattagcctttaagtcctcattcttgagacagcaccatgtctattcttggttgctgggaaactgattatgctcttcaaatagaaactgcagcagcagatgaactttaagaaaatataatcatgtttgtaagaagaaaaatttaataaaggaagaaatgaagcaaagcaaactcataaactgatctgttttgaaattccatttctgccctcatgatagcattattgacttaataatgaagcaatgttactcattcaaaattgtacagcaatggccaaagactgaatgacctctattttctgaaattgtttcattcacagagttcactcctgatgggaacatccagagacatcttcagagagctttgctttgacccccaccccccaacattttaaggcatggatctggaaataatgtagttggtttacaaaggtaagtcttattttacaattgcatattccacaaaggcatttcactttcaaagctcctccaagacaattacctccagattgagacacaccctgctcctgaattcatgcctgcataccagccattcttaatcaccttcctttttaatccagttggaaaataaaatgtttccttgttctctgaatgtacagtactcagatgtacagtgaaaatgattgatgctgaaaccgcctataaattctttgattccatcagcttttctctttctactggccatttcccattagtgtttaaacttaagactcacacatctcccatcaaataaacccccttcaccctacttcaccgatttcagtattttagcttctcctctccttattgacttcccatttatctttcagtccatcctgctctattttcacttctacaattgcacagaaatgtctctgataaaagttcccagcatacactttggaactgatattacttgatctcacttcagtggtaacaatatgctgctgatggaagtaccacagaactcacaaaaagcttttacttctccaggaaatttcatcatgtctgtctagacccaacaaagccaaaccctgaacaatggccatttcagcctccatttgacccaagccaacttatattgaataaactaatgctttaaaaattataatgagccaggcatggtggctcatgcctgtaatcccagcattttaggaggccgaggcgggtggatctctagaggtcaggagttcaagaccagcctggccaacatggtgaaactgtatctctactaaaaatacaaaaattagctaggcgtggtggcacccacctgtaatcccagctagtagagaggctgaggtgggaaaatcgcttgaacccaggaggcagaggttgcagtgagctgagatcacaccactacactccagtctgagtgacagagcaagactgtctccaaaaataataataaataaataaataaataaataatgaaattcaattgataatgatggaaatcaaccaataaacctacaatactttaagattctttttaaaagaaaacaatatatttttattagaaaaagtaaaggatttattcataataagtaaatcttggtttcagagctcttaatttactgattgactgtgatcagatgccagtgggaatgtgtctgtagcaccattactcacatgagggagtattttaaccctttatatatacatcactaatagtggaaccttgaagaagtccatttctcaatattgatataaattataatttatattgacacactagttttttttcccataagttttatattgaatccaagaaagctttatcagtgtctgacaccaagacatatgctttaaccgtaatgtgtttggaatgtccacagtatattccacggtgtgtgaatctttagctttagaaattagctttgacaagggagaggtcctgaattatccaacaacaaaattgaattattgtataagatgtagcgcccatacctgcagggcatgtgaagctcagtgattggataataagacttttactaatgttatggaacctgggataagcattgcgatagaaccaggaagactgttgtagttcttttatgactcagaaacagtatgatgacttataactaaaactttgttcatacaaggccagcactcttctaatgatgcaatatgcatttgatttatccattgttactattgtccacatgaaaagcaaaaattgacgtaatgtttatgatttaaataatgtaatatataattataatagtaataaaagcatatataataatgtttatattatgagtacgttaggtggggtttccttcttttcccttcaaagctggataaaattgaattatatagccaataacatgccctgtgcaagtctaatactctcttgaaaagtgaaatctctcaggtaagccaaagtttcattgtcacctctggctaaaaatttctacttctagtacgtgtgagattttttttttttttttttttttgagactgagtcttgctctatcacccaggctggagtgcagtggcatgatctcggctcactgcaacctccacctcccgggttcaagcgatttttgtgcttcagcctcccaagtagctgggattatgggcgccagctaccatgcccagctaatttttgtatttttagtagagatggggtttcaccatgttggccaggctggtctcaaactcctgacctcaagtgatctgccccactcccccaccgaaaatgctgggattacaggtgtgagtcaccgtgcctggctgaggattccttttttaaaagtttctacagtgttggaaaataatcaggagagtcaggcaatgtgaaggaactactcagatgtcactggccatctggttaagaagcacagtgatgccatcttgttctaggatggcggcagtagggatggagagaacattgaggagccattctaattcttcccattaccgtgttttatttttgtaatagcaatgatcactttctgcaattatattatttctgtgtatgtttgggtattttttatttatctactttattttcatcttccaccatgaaaatataagatcgaaatggcagagtaaagatgtgctttgtcttgtacactgtatcaacagaactttgacattgctgacagacagttgatgcacattaaatatttgatgaataagtggatgaattaatgaatggaaatagagcaatagggttcgctctagggtagtgtggtatcatgcaagtgggtgtgtaaattgggagagacctgagcatgtttaaatatactggggaattatgtggttggaacaataaattaaatattgagatactcaagcaagatgtcatgggacctaatacaggagataagactatgtgattcgcattaaacactcatgtagcatgtttatacgagatcttcagacttgctatataattattcagcactcaaggtggtgcttaggaaaattgaggaactaaagactcctttgtgttacctgatctgtagaaataatttaaaaccttgtctagttttctttttttttctcctgtcataagcttgttaagagattcctccatagaaactttttttggtaaaataataactgctgttcagtgcatcatttctaacaatgtgatgttagctacaaatatttaggtagcacatcccttcaaaataggcgcttgtggtctgggcgcagtggctcacgcctgcaatcccagcactttgggaggccgaggcaggcggatcacaaggtcaggagatggagaccatcctggctaacacggtgaaaccccgtctctactaaaaatacaaaaaatttgccgggcggggtgtcgggcgggtgcctgtagtcccagctactcgggaggctgaggcaggagaatggcgtgaacccaggaggcggagcttgcagtgaaccgagattgcgccactgcactccagcctgggggacagagcgagactccgactcaacaacaacaacaacaaaaaataggtgcttgcgataacttggagtgctgttcttactgatgctttcactttggtagctcacctctcctacgggaactgtgttctcagacatgtcatggggagtatgtcatcagcacagcttcattggtagagtttactaaaaatacaagttatctgtattttccttataaaggccttcgtatagtgtccaatattttctaaccagatgtacagtgaaaatgattgatgcttaaatacattttcatggtcaatgcaacaaccgttgagcaaaaaaattaacatttattgcagacactaggcagttgtcaaacaatattaatgtcattaaatcaataaatgggcacagaataatggaagcaaggtcatggatgaacagatggcagtgtaatggagtcaatcttttactgatttaaccactctcctcttatttctaatgtcccttccatcacgatgagttctctttgggatgatgtgtatctaactgaagctcctcctcaacagctgctgagaattgagtgttggtggtaattatccatatgatttttaatcagacacttttcacagattcaagtggaatgataactctatgggaaattgataggacagccagagttatgcaaattttggaaaaaaaattaatcaacagctaatacaaatattatgtctaaaggctaacaactggatgatcataataactcaatggctaataaataaactagggaaatccaagccagaattagaagtaaaaattggccattatataattatgaccaagaagttctttcttagttagcaaggggtacagctgtatgtttatttcaaagtaatttttttgtctgcagttacaatgttgaatgaaaggctaaaacaattccttccttagccctttccttttgatgtgaaaaattaactctcagtaccctcagtaactttgaatatgctttttatacccttaaagacaaaaataaagtcatcattttttcattgactgtaactattaatactatattcatgttactgtagctttaactgatgactcatttttagaacatattatcattgatctatggcaaatgcttttaaaattcctcagaagctaatcatttatgttgaaaactcacaaaactgcacataatataatagataaagggagggcataatgaagttttcatttgacttatctgggttttgggatttacccccttacagtatgtgagcctatgaataagtaggtgagcttccagtgctcaaaggtttaatgtacagtgtatttatttttaatctttgtgaattttctatagagcagagctgtttccagtgaattaaaccatatttacttctactacaatattgtagaatgtaattgttacctttactatatatatatattttttcttttttatttatttatttatttatttatttatttattttgaaaatgaatcttgctcggtcacccaggctagagtgcagtggtgtgatctcggctcactgcaaactccacctcccgggttcaagcaattctcctgcctcagcctccaagtagctgagattacaggcacatgcaaccatgccaactaattttgtatttttagtagagatggggtttcgtcatgttggccaggctggtatcaaactcttgacctcaggtgatccacctgcttcggcctcccaaagtgctgggattacagacatgagccacctcacctggccccctttactatatttaaagatgacattgtcatgtgatgtgtatgatgaaaagtatatcattgaactctattctcatatgaaagaacatctgattttctagaagatttatctgccccaggtatattcctgtgagaataatacaaaccaaattaaaatgaagtctgcttttttttttctattccttattgagattgaattcagaattccaaacaggtttgctattcattttcatcttgacaaaatcaaaacctaaatattctatgtgtcacctactgtgatgggaaagataaaactaattatttaattatcaaacatgagtaggtgaattatttttattaatcaacattacataaacgtgttttgagaataaaattttgtatcctcattttttaaccaaagacataaaatataactgacattctgtagcccaatcaatgatatatacacccagattgacctttaagagattaaaaataaatgtacgctgcatggtcaaatggatttggagatacataggctagtagatgaagcactagggctttatgaaacttttttgagggccggtgcggtggctcaagcctataatcccagcagtttgggaggcccaagcgggcagaccacttgaggtgagaagtttgagactagcttggccaacgtggcaaaacatctttactaaaaatacaaaattagccaggcatggtggtgcacacctgtcatcccagctatttgggaggctgaggcatgagaatcacttgaacacgggaagtggagactgcagtcagctgagattgtgccactgcactgcagcctgggcaacagagtgatactccacctcaaaaaaaaaaaaaaaaaaggttttttttttgagttagtgatacacgttaataaattaatccagagatttaaaaaccacttttactttccatgttaaaaaaaatcagcatactttccaactataacctaaaaatctacaaaaaactttccaaattctcagtaaaggaagtattgcaatccacaggagattattgctttgttctaaagacagttgaaacattttcgaatctctgacattttttagatcaccctttgcagggtagggttcacagaacattttttttcctgatcatatgacattgcctacataattttgtgattaaatgactttggaaaatcaggattgagacaagtaaacagtcctatcagaactaaatatgttaatgtatggcgtccccaaggggtgtgatatgcagcattaactcttaaatgtagataatcatgggactttaataagcagatacactttgtgaattactactttaaatattggtagtaatagattgcttaatcgaacttaaatttaaagagatgatgttggacttctagtgaatggaagccaagtatttctatttactagaaaaatgtacatgatctattatccacagtgaactagcaaaccttccatcttgatatttagttttcatattaattgtattatatttcatcagcttacattttttactcactagggcatacttttatttttttcattgcaatagcttattcaatatctgcctattcatatattaagtaataattttttttaacctgcatctcacacagagaaatcatgaggaaatctccactcattctggtcagcatcacagttgcagtatgttgcaggattcctgggagtcgatatgattttttctaatacacacatatgtttctcagcattgggcaaataacctctctggtaactgtgcgcttttctggttcttcccacctaccagctcaacagggtatcatctgaaaaaagaatatgagaaaggcgagtcctatttagcccaactactcaccccctaatgcggttctgcttccgctcagataatgacgtaaaaacagttttttggtgtgtgtgggttttttgttttttttgtttgtttgtttgtttgtttgggacagagtcttgctctgttgcccaggctggagtgcagtggcgtgatctcggctcactgcaagctccgcctcccgggttcacgccattctcctgcctcagcctcctcaagtagctgggactacaggcacccgccaccacgcccggctagctttttgtatttttagtagagacggggtttcaccgtgttcgccaggatggtctcgatctcctgaccttgtgatctgcccgcctcggcctcccaaagtgctgggattacaggtgcgagccactgcacctggccaaaagaaacagttttaagaaaataagtccaaaccctgcaacagaacatttctttaagaatactaaccagcttttttttttttaattaaaaaatatttacggctgggcgcggtggctcatgcctgtaataccagcactttgggaggctgaggcgggcagatcacgaggtcaggagatcaagaccatcctggccaacacggtgaaaccccgtctttactaaaaatacaaaaaaattagccgggcgtggtcgtgggctcatgtagtcccagttcacaggaggctgaggcaggagaatggtgtgaactcgggaggcggagcttacagtgaaccgagatggcgccactgcactccagcctgggggacagagcgagactctgtctcaaaaaaagataaaataaaataaagagactttaatatgttcagtaattacacaaaattaattatcttgagcaggccagttacataatttcttttgtttttgttttctctttctttctttctttcttttttttttttacacagagtcttgctttgtcacccaggctggagtgcggtggcgtgatcttggctcactgcagcctctgccacctgaattcaagagattctcctgtctcagtctcccaagtagctagtactacaggtgcattccaccccacctggctaattttgtgtttttagtagagacgggatgtcaccatgttggccagggtgatcttgaactcttaacctctggtgatcctcctgccttggcctcccaaaatgctgggattacaggcataagccaccacgcccggccctgtaatttcttgaaaacaattttcaaagattgttttcataaaaataagtagcagctatgtagagattgaagctacaatctgtttgagaccatggagtgcctatctaaaaccctaatgtcatgaggagatatgatttctgttattgcatttattagataaaactcccagctgcatattaaacatttagcgtgacatggttttacttctttgcattatcggagctcagagcacagtaccccaaagtatggtgccttggcatgtgtggattgttgcactaaaggagacaggaggggtttagaagcaagtagttctctttggccttctcccatccttctgtctcctgaaacaagccataaaatctagaaaggttatcttttgcctacctcccctgagagctcataagaccctcattccagaggagtcctgccccttacctggagaaaggaatgctacacatgaaaccgtcattgtaaaattataactgaggcagtgaaagagatctgacctaaccaactccatcttgcttctaatttccaagctgtccttcgtcattccttggcgtaggctgaactaactttggaaggaacttagtttataatttatagtttaaaatgaacataatgacagctctttcccaaaacaaatccctttcttgcttagggactagactgcctttgtaggactagtcatgcagctggaggctacgaggttctttccagattgctccaggggataacatcactactgtaaagcctaagaccagctcttgagatattttgcagacactgcacttgatggatcagcagccatcaccccgatcgataaactggctcatctgatattgtggccccactcaggaactgactcagcacaagaggacagctttgactccctatgacctgaccaatccgcacacccaactcactgccccccaccagttcacaaattatccttaaaaactctgatctccaaatgctccaggagactaatttgagcaataataaaacttcagtctcccacacagctggttctgtgtgtattacactttctctgttgcaattcccctgtcttgataaatcagctctgtctaggcagggggcaagatgaacccattgggcggttacacacagagagaccaagaagaatcagaacaaacaggccttgctgggctctgctcagtttattaccattagatcatatccattttgtccagttacccagttacgttgctccacaactattcacttctttcatcagatttaacataaaaatacagtttccccctgggtgtttgggtcttcatttctgaagcctcctgtgtcaaggaaaactttgattaaatacctttgttatgcttttctcttgttaacctgtcttttgttttgggggttttgggctgtaaaccttgtggcgggtgaagaaaagataggacttttctcccctagagtattttaaaagtcttgcggaggcatgtgcttatgtcaaagatgtctggaggcatggcttgactgttcattcaaagacaaagaaacaacactcatggactttcctgcctggaggaaatgtcacccttggccacacagcttctcagagctacgttcacgtccaccagcggcactgataactgactcctcagcactgtccagcgaatgctgcatggaggctcgcaggcaccccagcttagaaaggaggagcagaaggtaaatacctacctagtacacaggaaatcaaagagcaaagcttaagaagtgggcttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacacagcgagactccgtctcaaaaaaaaaaaaaaaaaaaaaaaaaagtaggcttagactcatcaacccctcaaaaatactcagccacttttatgttttcttccccaaccccaagctctcatcctgaggtcctgactgaatctggagcatgcttcagtatctccctaacttataagcgccactgctcattaaggctccctgttagatgagacctctgctgcaacagtctctctgcttgtaaacatcactgcatatatcaccacccaccccagcccagcagggaaaggaaaacaacaacaacaaataaaatgcaattctaggaatagtgagatatgcaagaaggcatcagtattaaactttctgttttgttttgtttgagactgagttttgctcttgttgcccaggctggagtgcaatggtaagatctcggcttactgcaacctctgcctcccgggttcaagcgattctcctgcctcagcctccgaagtagctgggattacaggcgtgtgccaccatgcctggctaattttttttttttttttttttagtagagatgggttttcaccatgttggtcaggctggtctccaactcctgacctcaaatgatccactcaccttggcctcccaaagtactgaggttacaggtgtgagccatcgcacccggccagtattaaacatttttttaaaaatcatgttgaaacttaaaactaggtagtagaaagtacgtaaaacaattaatagatggttttcaaataccactttcaacttaattactagtcattatattttctcttcagagattgaagagccaagacatcattacacctaaatgcaaaattgtgtgtttacatccaaatctctcatctttcttataaaataggaaataaaattttaaagataccaaatgtgtttagaaccattgaagatagtttaaatattgttaaacatttaggggactataacaaaaagttttgttttgttttttttttaaacgagacggagtcttgctctgtcacccaggctggagtgcagtggcgcgatctctgctcactgcaagctccgcctcctgggttcacgccattctcctgcctcagcctcccgagtagctgggactacaggcgcccgccaccatgccccggtaattttttgtatttttagtagagacggggtttcaccgtgttagccaggagggtctcgatttcctgacctcatgatccgcccgcctcggcctcccaaagtgctgggattaaggcgtgagccactgcgcccggccaagaaaaagttttttaaaaattagtgaaaatattagactctgaagaatagaaataataaataagaaaaatgtaaatgactttctcaacaactttagccactgactcccatcctcctctatgccctcaaattcaattttcagtgaatttcgcaggccaggagtcatcattcccgttgctgacagctcagctcctcagcctgggagtatccatttttgaacatgcattttttattgtacttgcttttttaacaactcacattcatggtttcattttagaatatccatggtgtaaacaacacattacttcgtgcaatggagacaatattgcttgattgattttgtattactcaaaaaaaaaaaaaggcgagaaaagaacttttatctgaggaatgtgagtccttttaaataatgaggcccagagagacattaaaatgaggcagcagtcaaatcctactccccgctttgagctaggtattcatcttctgaaactgcttattgccacaagtagctataaattaacttaataatgccagagcaaacgctataacccacaccctgtagcttaataatgtatagccaatcgctaatcaatgttatttctataaatcaataagaatgcctgacaaacaactttgtatcagccatgccttctcccccttttttgccttcaaaaatctgtttgtaacaaaggccaaactcatatccaaggttacatgggtccgagtcctcctgacagctgtcttcactttggctcagtaaactctttaaattatagagtttgtgtctcagcctcttccttttaggtcgacaaaatgatagagctttggaggtcaatatttatcaaaactgccatctttgggaaatcttctgcataaaagagctggatgtaattgagccagatgctgctttattccacagcactgcaaaatattaccctccctttcaactctaccccaattgaaagcttctggaaatactaagtctctcgtggatatttgtgtacattaacttttaaaagaaattctcgaatggcagctttgctgtggcagctgtcaggcatgcatatgaggaaatgtgttgtaagtgcacagataaggaattacctgatgtttctgtagacagattttcaaactcataattcttttcatgttcatcatcttctccccaaattaaaaaaaaattatcgtctatatatttatcttttcagctagggttttcctcatctctatatgcatttctctcattttcaaatatatttttaggacgcgcatgttcagatcatgtggactatatgttatcataacttttgttaaataaaaatatattatccagtatcagctcctcaaacaaaatgactttgggtccataattgctactgaaatgtcaactgacaaaaattcaaatatatttctggcacatcgattatttacttcttttgtatttaaaaatgaaatacaacctgcccaattgtgtaacaggcaaaagcattcttagatcttttacccctctaagaccaaatgcccaactggagcatttatgctgtttgtgcagcattgcccagctgcagagaagcccaaggctcagagggtaagaagtgactggaagttgtcttgctacgtatgtggtgcaggttctttaacttacataaaaatatatttgataagatggtcaatttgcatgagtatttacccaatcagagggtgcagggaacagttatatggagattttttttaagctattacatttacatcatttagaaatcaaaacaagataagttacctaccaagggtaccttccccatttctacgcccatcatagggagctgagaatggcctgactaataaatttgcattagaattaacaaccacagggatggcatactttacaacagcaacccagggacaaggaaaggggagaggatgttaccaagcctagggaaacaactcaggctcatggtgaacagggagggaaactgatagtgtctaactaacacaattttaaattcagtaagaaaatggtttgttagatcatgtagctcacttactcgccattgaaaaatgctgtgagtgtttccatggaaatctgaattcaaaagatctttcctttaatcatattctgagatttacacggaaaatatctaaaataggctttctttttccttgaacattacctactctatattcaccctcaggggtttttctctcaaatgaatcaaatataaagagaaccttgtagaatactgagttgggttgtggagttgacttatcaagtgctatttttctcattctcatcacagctcatagcgtgttgggaaaaaaaatgatgcctgaatagctcatatgggcaggtggtcagtataattgatttccagttatgtatggttaaaatttaataatagaaaaaacatcctccgtaaagggaagtattgagaatacatctataaaatgttttcttaagagtagaataagttaatctgtggataataggtgtgtgtgtgtgtgtgtgtgtgtgtgagaataatccctctaagtcacagatttttacaatactaatatttgaaacacccaagcacgggcacagacaattatgttatgtttccctaattgtccatagcttatcttcaaagaatgaaagaatgttagagatggagggaagaaacagcttaaggaattataagtaacctgcaaaacagaaaagtatatagctgatgttcaccacctttgaatcatgaatagacttgggagactaattttaagaatggcaaaatgttgagacagtttctgtgatgtggtggagtaagacacttcagaacgtgtttgctctgactcactggagcttgtctggcatcaaaaagggtggttcttaattgaccctttgtccaccctgtcaagagcggtcaaaagaacacacaatttagcaggttaaactattttaatttcatcatttaatgggacttcacagtataaataataaaatttactagatgtcatatgaaaccccatgtttcagttcatttgccatattacagcaattttgcaatattgcaactttttcctagtttttataatttcctataaaatgtcttctataatccatctatgtgatttctaagggaaaaagtgatcttatgtaaaaggaaaataaccttggattttcacattagataggaatgtactcattcccatgtctcctggaggaaaaaaaataaagaccctgtcaagaaaacattgacagtactataattagtgagtccatcattcatgatttggaaattgacctccaagaaagtggagaaaaaaccccctgtctcacagaaggcaaaaatcatttccatttatgtcaaaataccatcctttaagaagaaatggagggcactgattctgatgagaaaggggaatgcaagtcatgaaggaattgtgaaataaacacacagagaggatctatcctgtcattttatctctaaataaagaactgatcgatgtcttggactcatgttgatgagtagtgagggatggatgtaacactagcgtctgtgcccagatacacgaggataaacgacgtgctacttcatgactctgaggatttgctgccaagatggatatttaaagtgcagaaattcttccacaatattgctgcccttacagagacagggcattggttaggccctgtattttatccaggctaaccccctcatcatacagatgaggaaaatgagtcctggaaaaattatgatgacagaactggtgaactctgacacttcgggttttgaccttggctaaattcttagattttgcccaagaacacactctaaggtttctcgctgtagtttgactgttttgttctgaggattttggaaatagtatctcctgacaggatttctgtgttttttgctgctcaactggctctgaaatttctgaacatgccttatgcagtttcaacattcttctgtaatctctgctgaaacatttttgtacctatattttatatcgatactttcagtgtgtgtgtgagtgtgtgtatgtatgttctaggacccacttgagaaagattacccagtcaaagttcatataaatgctgcatattgttaggtattgaataagtatttggtatctctttatgttatgaagaagtaaacagtgtatctgcgtttaaatatgaagacagggttacagtggaggcatgatgctatcatctagtgacactcatcttgcagtatcatatttttactagttaagtgttctttattttaagtaggaggtacaggattctgaagcatagtgtaaaagattggaaaaggtttcacagggaaacctgtgggtatgaatcatacatgctgtggaaaccaaggatcttctcaaagtcatagttactggacttcatatgaagccctgtgattaaagaagcaagtcagcttagtaatagccaatattgactgaaaatctgaagggcatttgtttaacctccttaaatagttgttatccaacaaatctgctaaaaaatagttttcaattatttagtacttactgcctttgttcacttaaacacaacttgcaaataagaagtagttattgcaaaaggtagaaatgatcatccaatgtgcaattccttgtcatgaaaaccctccaaggctggtttaaaacagaaacttccttaaatgttctgcaaataaaaattcaagataattaaaatccagaacaaaagagaaaatatttacataaaacacacttctacagtattttaatttattctgaatcatcattgaatagaatattttaatttgttcaagtaaatattttactgtgttcatgataggggcttagtatttgcaagtgatgggccttgttaatcttcagaataagtttaaatgacagctcagcagggcagcgtctcccgtgcagcagcccctgtggagcagcaggaaggaaggctctggaggaagccgcaggaagccgatggctcctgtgagagactgcctgactgatgctgtcacggtattgaccctctccctaagagccctgagatcacactcgccctttttacatcacccaacagggctgacttaacatccagggaggacaaataaaggggaagaataaaatagtccaacaaaaccaggacagaatgcacttatgtcattaatggagctacattcttactttgaatgaattacctacattatgttaccttcctaaagacttactgaaaaaaaggtgttcaaggaactaagggaaacccagggtggcacttgaggttgagggtcacagaccacactctgaatagccctgaggctgggtgcagggccaggctgcctgtgtgcagatctcctggccgtgtgttagaggttgaaccatgcatctctcagaattcaaatgttgaatttttattttatttttatttatttagtttttttgaaacagagtctcactctgtcacccagactggagtgcaatggccctatctcagctcactgcaacttccaactgctgggttgaagtgattctcctgcctcagcctcctgagtagctgggattacaggcacctgccaccatgcccagctaatttttgtacctttagtagagatgggtttttgccatgttggtcaggcttgtctcaaactcctgacctcaggtgatctgcctgcctcagcctcccaaagtgctaggattacagatgtgagccaccatgcccagcccatatgttgaatttttaaacactgagtactgcagaacccaggaattatttggacatagggtctttacatgggagttaaaatgaggttgttgtgaagggaccctaatccaatttgactaatatccttgtaaaaagggaaatttggagacagacacacgtagagggaagatgatgtgaagagatcaaagaagaagacaggtgtctacaaaaccaggaaagaggcctggaatagatgcttcgttcatagccttcagaaggagccaaccctgctggcaccttagtgttagacttctatcctccagaactgtcagacaaaaaatgcccattgtttaagtcacccagtgtgtggcactttgttatgatgtctctagcaaactaatataccttgtgaccttggcagttgtgtcttcctgcctctgtaaaatgcaaatattactgatatattacctcctagggcttctgtgaagaggagatgagttaatacatgcaaagtgctacaatagtgcagacgtaatattaatactcagtaaatgttaagatgattattaatatcaacatcatcatcaccattgtataaaaaaaagaaaattggggctgatatctgatctctgcaactttaccatgcagcatccctgtccattgctttttctaaattctattattaaccttgagtgtcttgtaattgatcatgtttcaacctttctttgacagcaagtactctcagaaataaaagtattactcggaccaagcaattgaacaacatattcatgcatttatgttcatgtagaaataccaattatacacgttttattttattttattcatgactctattttgtatcttatacttttttccccattgaaatgaggtgaattaaaaataaaaactttataaattaattagctgcaaaaatacttatttttgtttgtttttccaaatggttgcaacttacatagtgtaaaatacaattcatgaaagtggaaagatgcagaaatcagaatggaaatgagaaccagcaacctgagagtcccacagaaatattcagtcacatctgtgtaaccaggggctgtacagtcttaggtggaggtattccagatttttgtttcttagtttctgtcagatgtaaaatgtgtatgtggaactattgtacactttctttgtttggtagagacagtctcgctgtgttgcccaggctagtctcaaattcctggactcaagtgatcctcccacctcagcctctcaaagtgctggtactacaggtgtgagccaccatccccagcctactgtgcattttctattatttgaagcaaaattggggccacaaagaaggtcatctgtagtatgccaataacataaacctctgacatttcagtaaaacattgcctttgcctctgcatagtatgccagcatgttctgcagggtgggcagccgcaagcagtggttagaacaggggctctagaaccagggcctgaacctgaggctgtgctctgctctccttaatagtgaaatcagaggcaagttgcttgacctttctgctttgtgtttctgcttttgcaagatgcacaatatctggtttgtggagttttttgaggactaagggagatagtgattcctatcaaatgtttaccagagcctctgataatctgggttttctccctccacttccttcccctccttacttcttcaagatgattctatttaatggcatgttggaaatcatgtcagcagtcataacatgccaaggtaaaatgaaacttttttccttaaaagtaggagaatgaggtaagagatgattttagaagttaaagcctacccaaacataaaaggatatgatttgtgtcactgtcatctaaagtgtctactgctacattttccatggggctgaagttttgattaaaaagaataatgtcatatcccaggtgtatccctaaattggtaactacttccgaaagtcttttttaagcttgtacttaaatgacatttttttaaggataatagttttgtattataaaagataaatgcacaaagcagctacatgtaaaatgccactttaggacatgctgttctaacacaaatactgtcaacatctcatttgtgagtgaactgacaagatgtccagggaatgagttacagtggagaaaattcaacgtgcatcacagaatagttaccagctcctggccctccacagatgtggacctaaaaccacctggagggcagagtcggctccctcccgctgtgagtgcttcctagtgagccagcagctgaaggcctccctagcttcacttctccagagtgggcatggagataactagtgaaagtggtcacaaagtcggggccaagaagtctctaacccctaaatcaagattgagagatactggaccgggcacagtgtctcacacctgtaatcccagcactttgggaggcctaggcaggctgatcacctgaggtcaggaattcaagaccagcctggccaacatggtgaaacccagtctctactagaaaatacaaacaaatttagctgggtgtggtggcaggctcctgtaatcccagctactctagaggctgaagcaggaagaattgcttgagccccggaggcggaggttacagtgaacccggatcgtgccactgcaccccagactgggcaacagagcgagactcagtctcaaaaaaaaaaaaaaagcaaagaaaagaaaaagaaaaaaagatggagagatactggagaaattcttcctttatgcatccctcatccttgcatcaattttttcctacaaatcaatggaatgtgcacatatggggcattatttcacgttaaaggaactaagtccatataaatgatttgttttttgagaggtgaggtctcactttgttgccgaggctggagtgtagtggtgtgatcagacctcactgcggcctccacctcccaggttcagatgatcctcccacctcagccaccctagtagttgggaccacaggcgtgccactgtgcctggcaaatttttacatttttttgtagaaatgttgtccaggttggttttgaactcccgggctcatgtgatcctctccccttgagctccctatgtgcaaggattacagctgtgagccactgggcttggccaagtagaaattatatcctgctactagttgaccaaacatgattcataaactataactagtatggccgccattaatctaaaaattaatttttagattaatgtttattgacagtatctactctataaaataaaaaaataaaatatgcttttatgatgtggaccatagtatccataagattgcttttctgtttgaattggctataaaaatggaaaaagtatcattttgtaactgtgtggcatttgctcatttattcaacaataataccagagtggaaagcaacaagttaggtgtgacataatatagaaatggttttgttttgtttgtttgttctacatatattattagtaaggtttctctagagtactgtctctctctatctctttctatctctgtctacacatagacacacacacacacacacacacacacacagatgttcctcaacttacaatggggttatgtcacaataaacccatcataagtttgttacaggaaagaggtccagatccagaccccaagagagggttcttggatcttgtgcaagaaagaattcagggcgagttcacagtgcaaaatgaaagtaagtttattaagaaagtaaaggaataaaagaatggttattccatagaaagagcagccccaagggctgctgattgcgctttttctttttttttttttttgagatggagtcttgctctgttgcccagcctgaagtgcagtggcactatctaggctcactgcaacctccccttccagggctcaagtgattctcctgcctcagcctcctgagcagctgggatctcaggcgtgcaccaccaggcctggctaatttttgtatttttagtagagacagggtttcaccttattggtcaggctggtctcaaactcccgaccttgtgatccacccgcctcggcctccgaaagtgctgggattacaggcgtgagccaccacacctggccggttgcccatttttatggttatttcttgagatttgccaaacaacgggtggattattcatccctccccttttagaccatatagggtaactttctgacgttgccatggcatctgtaaactgtcatggtgctggtgggagagtagcagtgaggacgaccagagtcactctcatcgcaattttggtttgggtgggttttggctggttgctttactgcaacctgttttatcagcaaggtctttatgatctgtattttgtgctgacctcctatctcattctatgacttagaatgccttaaccatctgggaatgcagcccaggagatttcagcctcattttacccagctcctatttaagatggagttgctctggttcacttgtctctgacaagttgaaaatgcatttaatacacctaacctactggacctcatagcttagcttagcctaccttaaatgtgctcagaacacttacattagcatacatttagcctatgtttgggccaaatcatgtaacacaaagcctattttataatgaagtgttgaatatttaatgtaacttattaaatactatgttgaaagtaaaaaacaaaatgcaatctttattattttagctaaaataattgtcaatttattaaataaaaacaaaacagcccacaccatcattagctgcaaaatcattttgaaccattgtaagttggggactgtctaaagaattgagaattggctcaagtaatgacagaagctgattagtatggaaatttgaagtcagcaagttggagacccagcagaggtaaggtatagtccaaaagcttgcagccttgaggctcaagaagagccaatgttttcgttcatttacgaatgtaggaaaagaccaatgtcccagttcacacagtcaggcaaaaggagctccccagtactcacgggagggtcagctgttttgttctattcaggcctcccaccaagaggataaggaccatccatattggggagtgcagtgggcttcactcagctagagattcaaatgttaatctcattcagaaaacaccctcacagacacacagaataatgtttgaccaaatatctgagccaccctgtggcccagtcaaactgatagtttttccttaggttatctccagtgtcatttaaatattaatatttatagtatattattgatgtaaatattaacatttattacccaggggttgtgttctcttgataatgttctatttttttaatctctgtgaaaaaatgttttatgaagtgtggaatttatctgctacactgacatattctgcattaatctttctctattttgtggttgtcaatcactggtacagtttcagagagcaggaaatgaagattcagcctttaactcctacacaatccacagtgtttttttcccctcagaactgtcataaaaactgttgtattttatttagatttttaaattaacaactaaagccatattctagtaatactttaataatctagatttcatattttagagtagaaggctgcatcatatttaaaatcactgcagagactttgaggttttcaaattaatatcatattaaaaatttttgcactctgaaggctttcatttattgctttaaaaaaatgttgaaactcagagttcaaatgatttaaaaaactctacatctagatacagttaaggtaaactttgtatatctctgtaatgactttcactgcccctcattatcaatcaagagcattgagataaggactggaaaatattaaagatatatgttaatatttatataaacatattaaatgtgtgtgtgtcacacatacacacacacacagagcaagagaaagggcaagagagggacagtaactgtcttcagaatatcaaaagttctgctaatcggctcttttgcagaagcttgtcctcactctccgcataggggaaagagaatgagcttaaagacagaacttcctgctgaattaattaaatatatccattactactgacagaatcagtgaggttaagcccctctgaagatgacaagataaattgtcactattatggcactagaaatgagatactgggataagatttcattaccgtattatcacaggtttacttaattggcaaagtttcacttaagaaggatgcagaaattctgaacacaagttagcatttctagcacgatggtacaagatgtgttattgagtaagtcaaagatgccataaacgcaaatttcaaggaatggtgtaaggctcgggtggtggctcacacctgtaaccctagcactttgggaggctgaggcaggtggatcacctaaggtcagaagttcgagaccagcctgaccaacgtggtgaaaccccgtctctactaaaaatacaaaattagctgggcttggtggtgggtgcctgtagtcccagctacaagggaggctgaggcaggagaatcgcttgaacccgggaggcagaggttacagtgagccaggatcgcaccactgcactccagcttgagcaacaagagtgagactctgtctaaataaataaataagtataaaaggatggcaggaatgcaaaacttggtgcacagtgcgctgcagtggtgccgcctgctgtctgatggaaacatcacaaagacataagcacagactaagaaaaaaagttttaaaagtcaaagggataggtaagtaaaaaattgaatgcaatatgtaggaaatgctgctttcttatttttatttttattatttatttatttatttatttatttatttatttatttatttatttttgagacagagtctctctctgtcgcccaggccggagtgcagtggtgcgatctcggctcactgcaagctctgcctcccgggttcacaccattctcctccctcagcctcccagaaatgctgctttttaaaagtggccactcttatgctaataaagccatccatgagacaagaacgtggttaaaatataatagcacatacagaaagcaatactgctttgtccaagtcagtcccattagtcctggcatgatttctatagcactcctttcaaataaagaatgtcccaatttaaatgaagaacactatataatcatcctaatcataatagcaagattaagtcatcatttgtagtaaaatcttacaacagattgtgattggctgtgtagtgacaaaataattggaaagtggcaaataaaactggtcatagagggtcttagactatatttgttgccttgaagacatgatgggagaattaaacttaataaatgacctcggcctagatgaaatatccttcttaaaccaaatatttctgcaaggtatggattgaatcttcataccaagtccaacgaatttttgtcctgctggaaactaattgagaaggaaattaacaggaattaaggtgagatgaacaaggtgagttgcaaaagtgcaggctcagatcctgctaaattttaatatttgctcatggtgacttttttgcattaattttaatatttttaaataatgtattaaaacattatttattttgattgctaagttttgtgcttacccatttaattgtgttcctaaggggagtacctcacttacctcaccttgtaacagattctatacaaggtatacctgggattagatataaagaacaatgaagtcagaactgtgttatgggggtttccactccagctacctgaaactgaggttgccctatcttagtgagttcaaagctggagattctgtaaatagacacggggactgtgaggtccctgcacaaacaggtcatatctgtaaattaaactttgtgattataataattttttttttgagatagagtcttgctctgtcacccaggctggagtacagtggtgcaatctcagctcacagcaacctccacctgctgggttcaagcaattctcctgcctcagcctccagagtagctgcgattacaggtgcacaccaccacacccggctaattttttgatttttactagagatggggttttgccatgttggccaagctggtcttgaactcctgacctcaggtgatctgcccgccttggctttgagaacaagaacaccatgtctgctggtgtgttagtcgattttgtgttgctataaagaaatatgtgaggctggataatttataaagaaaagaggtttatttggttcacagttctgcaggctgtacaaaaagtgtaatgacagtatcagcttttgctgaggccacaggaagcttacaatcattgcagaaggcaaagtgggagctggtgtatgacatggtaagagagggaacaagagagatgccagactttatttatttatttatttatttatttatttatttgagacagagtctcactctgtagccccagctggagtgcagtgatgcgatcttggctcactgcaacctctgcctccaaggctcaagcaattcttgtgcctcagcctcccgtgtagctgggactacaggtgcactccaccaggcctggctacttttttgtattttagtagaggcgagctttcaccatgttgcccggggtggtctcgaactcctaagctcaatcaatccgccggcctcagcctctcaaagtgctgggattacagccgtgagccactgtacccggcctagactcctttaaacaaccagcttttgcatgaactaatgcagggaggacttattcgttactatgaggaaggcatcaaaccattcatgaggtctccacccccatgacccaaacacctcccaccagggcctacctccaacatgggaatcacatcttaacatgagatttggaaagaacaaacatccaaactatatatatatatatatatatatatatattttttttttttttttttttttttttttttgagatggagtcttgcactctcgcccaggctggagggcagtggcacgatctcggctcactgcaagctccgcctcccgggtttacgccattctcctgcctcagcctcccgagtagctgggactacaggcgccggccaccatgcccggctaatttttgtatttttagtagagatggggtttcaccatgttagccaggatggtctcgatcttctgaccttgtgatccgcccgcctcggcctcccaaagtgctgggattacaggcgtgagccaccgcacctggccatctaaactatatcagctggtggtttgccctaagcttttctcccccaagtttcttttttcagaaataaagtttgtctttatctgacgtcagcagattggtgtttgcttttgcctgctgtattcctttagtttctaaaatagtccaaattcctcacccttccctgaaaatgttgctcttacgttgacataatatgtctagtttcattcagtggttaatattataatatagtactcagattagagtttgcagctgttgtcgttaaatttaggtcattctaaatttacaagttagttgggaagaaaacaaccgcaaattctcaaccctcatcaccatttctgcctctcagtgctcatataaagtcactacagaaaaagaaggaatgcagcaattaaacaagctcatctgtaacacgattaatttttaactctttaattcacttgtttctcataggaaactacattaacatgacagggttttttttttgtttttttttttgttttgttttgttttgttttgagacggagtctctctcttctcccaggctggagtgcagtggcgccatctcggctcactgcaagctccgcctcccaggttcatgccattctctcgcctcagcctcctgaatagctggaattacaggctcccgccaccacgcctggctaattttttgtatttttagtagagacggggtttcaccatgttagccaggatggtcttgatctcctgacctcgtcgtgatccgcccgccttggcctcccaaagtgctgggattacaggcgtgagccaccgcatccagccatgacagtaatttttgaaaatgaattggcacagcaattcaagaagaggaaatcggacccatggtctctaaaggacttcccagcaataatgtgctgggctgttcagaagtatcactgataaaaggctatgcccatgtgcacaactggcctgacctcatgtgcatatcagttcacctcaaccaccatcccgtctgctaaaataagtcacattggttgcctcccaaagttctctattcaaaccagtaaactcagttaaataggttgtgaataggaaaatccaaaagtcactgggaaaagatgttataaactaaaatattcatagaaacattttttatgaaagccagaaaaggaaaaataaacaactaagatgcctaaaaaccaaaaaatggatgaataaaatgtggcagatgcattcagtggaatatcatatagcagtgaaaattaaggacattaattacatgtatcagcatgcctgaatctcaaaaactcaagttgaacaataatagcttttaaaaaaacacagagttaatatgtatgttccaagtctacgaagtctttaaaaagaggaaaaacaggccaggcgcagtggctcacgactgtaatcccagcactttgggaggccgagatgggcggatcacgaggtcatgagatcaagaccatcctggctaacacggtgaaaccctgtttctactaaaaaaccaaaaaaattagccagacgtagtggcgggcgcctgtagtcccagctactcgggaggctgaggcaggagaatggcatgaactcgggaggtggagcttgcagtgagccgagattgtgccactgcactcccgcctaggcgacaaagcaagactccacctcaaaaaaaaaaaaaaaaaaaaaaaaaatagggaaaaacaaaagagtatattcaaagaatcacaaacaaaaagtaaaggaatgataaacaaaatttaggatagcatttaccttgaggactaataaatattggtaatgtttaatttattaagctaggagatggacacatatattttcattcatagaactttttttcctaaatgtatgtgtatgctatatgtcacatgcatgacatatatgtgcatgacatgtgatatatatgtgaactacatatagttcacaaaaactaaatgtagatatggtatacaatcacacaaaggcacttaatgtatcaatgtgtctatatatacatttatgcctaacttatgacaataaatatactctcaaatacctggtcatcattaaatctaatacgtagaatattaaaatatgaaagaggatgctgtatttgttattagtcatttttctccagtctattttcttttgcatcatttaataaattagtagagaactttcctcccattccttttagtgttttaaaatcttttaatttaaaaattatagctcttagataattgccttatgtattgtttttaaattttgtttcctatgggttgctgtaaatctatcctaagtggcaaagttttaaaaacaatatgggtcaaaagtgcacaaagctctgaaaatgagaaaagaaaatgaccaaacctttaagattcctagcattattctgcctatcaccataatgtttgcttggagggaggcaggctatgaactgaacaacctaatttatggctgatgtgctctctggccattatgggcagaatgtgagcttcttcacagcagtggctctcagcatttctcttcacgttctatgggctacagcaagtcacatgaccaatcccaactccattgtgtcagggatgtataatcctcttacttggaggacagcaagtaattgggaacagtaatacaatttggcacacaaaacaaatcttcagagagtgtcagggtcaagagaagcatttgtccgagaaaaagttactctaaacttgcaaaaagataaaaatcataatgcttgattaaaaaaatactgaattattttctaattatttacttgaccctaacctgacaacatttataggagtgatataaagtcagactatttacagactgtgagtctagaggtcagcagcaaaatttagaaattatcatgactctgtagcccagtggtttactgtcataaaagatatattttataatgaaatagaccaccaagtagaacaacagaccactgaaataaaccatcaaatgacatcctataatttaaaggtatgatgaaaaatggaaagagttgtaaatgtttcttctagagttgtcatttggtgcttctgttggaagggctatggaggaggccgggcgcagcggctgacgcctgtaatcacagcactttgggaggctgaggctggcggatcacgaggtcaggagatagaggccatcctggctaacacggtgaaaccctgccactactaaaaatacaaaaaaatcagccgggtgtggtggcaggcgcctgtagtcccagctactcgggaggctgaggcaggagaacgacgtgaacccgggaggcggagcttgcagtgagccaagatcgcgccactgcactctagcctgggcgacagagcgagactccatctcaaaaaaaaaagaaaaaaaaaagtttgacacagtttgatctttttctaacacctggtggcatttttacagcataacctttaaaaagtcattctagaatatcctaatagatgtatacatccctctacctaaatttttgtagatgttatttgcctacatagtgaatgacattgtatttcagcagaatttattattcaacttttaaaaacaaagctcctgcatttatatccattttccatatctctatgtcataaagataatgaatttaattggacaattttctttcaaatgtgtgcagcctccttccacttccaggtctgaaagaggacagtatattttatagaccacacgattgccagagtggaaactggagtgagtggaagattccacatagttttacttgtgatactctagagactagtggtgaggtgtcttggagatggcataataatacaaataactaaatattactgagttgttactgtatatggcactatgttaaaggtttcataggcatcactcctcatcacaaccattttttttaaacagctttattgggataattcatatatcatacaattcacccatttaaagtatacacttcagtggtttttagtatgttcaggggttgcacagccatcaccacgattaattttagggcattttcatcacccaaaaaagaaactccatgaccattagtagtctttcctcatttctctcctccctccatctatcctctcctcaccatccctcggccccaagtgattgcttatcttctttctgtctttatacatttattatttcctggacatttaactatctaagtgtaattatatatcttttggccagtatcttcccattgcccccaacatcccagtctctggtaacaaccattttactttctacttctatgacataaactttttttttttttttttgagatgaagtctagctcctgtcacacaggctggagtgcagtggtgcgatctcggctcactgcaacctccacctccctgggttcaaatgattgtccttcctcagcctcccaagtagctgggattacaggcgtgtgccaccatgaccggctaactttcgcatttttagtagagatggggttttgccatgttggccaggctggtctcaaattccggacctcaggtgatccaccctcctcggcctcccaaagcgctaggattacaggcatgagccaccacacccagcccaactttttagattctacatgtgcgtgagatcatgcaatatttctctttctgtgcctaacttatttcacttaacctaatgtcctctgggttcatccatgttgttgaaaataacaggatttcattctgttttttggttcaatagtattcatatatataccacatcttaaaaatccatgtattcattgatgaacacttaggttgattgcgtatcttggctattgtgagtaacactgcagtaaatgtagaagtgaagacatctctttgacatactgatttcattttctttccatatatgccataagtgagattgctgggtcatatgctcgttctagttttaaggttttgaggaacctccataatgtttttcataatggctgtactaatctacaacacaacccattctaaaatctcattttaaagatgagaattatggtggatcagccattcatccatggtcactcagccagcaaagttcagagccaggtcaggaacatcacctgtcctctgcctcaccttgaaccatttcttgtgttgccttgcagggagggtgttgcctgccccctcatgtgtcagtctgttaagtccagtagtgaaggaaagtgttcacatgtccatatgcactgcagatgaagagagtatggaagcttggagggagaaattgctctctttctttctgtcctttttttttttttgagacggagtcttattctgtcaccaggctggagtgcagtggcacaatcttacctcactgcaatctctaactccctggttcaagcgattctcctgcctcagcctcccaagtagctgggattacaggcagatgccaccacgcccagctaatctttgtatttttagtagagacggggtttcaccatgttggccaagatggtttcgatctcctgatctcatgatctgcccacctcggcctcccaaagtgtctgtcctttctttattcaccagccacaatgacacacagaacatagtaggaagaaaatagtttatatttattcctaagaatataaacttctgttaccattctaaatttccagaaaaacttattgtgagtgctaaactaatatcatcctgacctaagacaaattgtcagttcctaagggtgagatttataggagaaaaccatgtctacgcttgaggcagagttcttagtagagatacaatagccagttgctattatttcaaagtttgtctgtccctaaatattgcctgcttaggtctgactatgctaggattagtgatcatctgctctgaattaaaggtttagatgcactcttcccaggataaaattaagtttggggactttctcttttcctgggagcaaaaacctcaggaactaagtgtgccatatgctggaagatggaaacattccaacagccagaagtagagggaagataaaaatggcttccctaaagcaaggcaaatcagcgacagccagtcctgtggccaccactaatcacttgtaaatgaatgctgcgatgtgtttcaaaagccctcattctgactctgcctgatctgctactgaaatgttaattatatgcctaatcttctcttgcaagcaaaggcagcagagttgctaaagatcatagcaggtaaaaaccttcaaggagaggtaaggagtaaatggagctgggagggaatgctgtctctcaggacagagcctggctcattgaaagggcatagtcctaccctataagggatgcctcccagtgtgaccaggtcttctatgatttctttttatgagaaaccagaaatctgattatgttcatgagaaattggagttttacaaattagcaaaactgtgctgtgctgagaaaatagaataaacctgaaggccagaggtgtgctgggagagtcacttacagaaccagagcaaatacttacatagagcaatgatgtgttttaataaaaacagggactactgtgctttgtaaatgtctttatgccttctaaacgtcctttctcctgaagtctataacgtgacatgggatagcaaagtattttttggcatgaaccattgcattgaatatcttaacccatttgtgttgctattaaaaaaaactcctgagactaaaaaatgtatttaaaaaagaggtttatttggctcatgattctgcagcccatacaggaagaatggcaccagcatctgctcagcttctggtgaatttctgaggttgcttccacacatggcggaaggcaaagggaagccagcatgtagtgagatcacatagtgagaaaagaggaaagaggggggagggggtgctaggctctttgtaacaactagctttcttgggaactaacaaagagctcattcatcccctctccccggggagggcaacaatcttttcatgagggatctgctcccaagaccctaacacctcccattaggccccacctccaacacaggggttcaaatttcaacatgaggtttaggagacaaacatccaggctatgtcattggatccctaataggctgaagtaatgtgttaaaaataagttgtaaataattatatgcaaaaacacatagcattttggaaactttgcaagataatgaaaatatttatctggattttaacttaattcactccatattctacacaaacatatttttaaaagataatacaatatttgagacattaatatatgttagataaccaatttacatcctcaagagctaagaaagtgttaagttgccctttcttaataaaaacaaaatttatgatgttaactgttttttgtttgtttgtttgttttattgagacagagtcttgccctgttgcccaggctgtagtgatcatggctcactgcagccttgacctcctgggttcaagtgattcttccacctcagtctttggagtagctgggattacaggcgcatgccaacatatctggttattttttatagaagctgtgcttcaccatgttgcccaggctggtctcaaactcctgggttaaagcaatctgcctgtcttgaccttccaaaatgctgggattttaggtgtgagccactgtgcctggcctatgacgataacttttttaaaagacaaaattagaacaaatttagttatggatgtaattggcttctatttgtaagtcatgaatcagggcagccggcattctacaaaataggatgagagcttccacagacaatggaagaacagtagcttctgtaaaatgagaacaattaaacaaaacaatagacaaaaagctgattggttaagatcagggttaatccaggttaatttgttgtaagggttaaagcagagaaaagttcctttttgcactgactcaggtagaccagaatttcctgtcttgaggaaaaactgctctgttctgggacctgtgtactttcttaaagtttcagtttgattatgtggtttaacatagcacatgaataacaatgcgattattttaagagttattataataaattttgataaatttgctcaaagtcattatctctaataatcaaattatctcaaatttaattaattgcagtatgtgtcatttatttcaaaagtgaaataaaaaccttttccacaaatcacagtttagtttattttcaaattcaaactttacttgcttcattgaatctagcaaaagtaaatgtttcaaaataatgcaaaaaaaagaggtttgtaaagttggtaagaaaatatttgctgagcaagtaatcagatgtttattgtcttacctaggtcatttcttatatatttacattcacattgatttgtattagctatcaagttaatcatgttaaaaaaagtggtaccataatgaattgtgtttgatgttgaaattaatatttaaagatttaaaaattatgagagagtattctgtgttatctcagaatactggtaatgtcttaaagatttctggctacaaagtagttttacaagacattagttttatgggcactgcatgcattgcattgatcaaagcagcattgcattggtatttaacactaggccatgactgaaaggtcttcagaagacatcatgatgaactacatacagagtaatggcaagtttactgtaaaattaacattctcagttgtcacaagaaatctgacaatcactaaaatggcaagcactgtgttctatttgtgtccttttcagacatgattgataagaatttgttaccttattagcatgtcataagtagacagcaaagtatgttttaaattcaaaaattattattttctgctcatgttctactttcagcaatgtacacagtgatagtaatgaaagcagccatcagaatactctattttcttcatagttagctgccaaatacttctttttttctatccagatcatacttgtattgcttttgtgcctttgagcatagtcataaattagtacacagaggaagcagggcagtgacagctatacatttttctacagaagatcagctattaaatcaagaaccaagagaaccatctcagcctggacactgagaaccgaagccacaccttcccactgatattaacatgactttgttattctattgttccattagtattacttttcgaggactgtcctagctaaagaatggtttgatttttcattataggaacttcccaaatgctttatcaactcttcaggggaagtcatagaccgagtttacagcttgagtctttgaatccttccccacaaatcctcacctcactattttctctaagcccagactgttgtatcatgattctcacacaattctaatcaaatcctctccttcagagacccatcttaaaacaaacttgcagttctcaataaattctgatctccccttctctcctctgagatgctgatagaaatttacaaaggctgtactctctcccttgccagtgtattagttttctattgctgctgtaacaaattaccacaaacagtgttgtaaacaatccagacttgttatcctacagtcctcttggtcagacattccatgtgggtctcactgacctaaaattcaggcatcagcagggtagaggttcctcctgcaggctctgggctcctgtgtctgacttttccagcatctagaggctgcctgctgtcctcagcccctggccccttcctccatcttcacagtcagcagtgataggctgggaggccttctcacgctgccatctctttggttctttctcttctgcccccctcttccacttttaagatcttgtgattagccccatctggataatccaggataatctccctatttcaaagtgagttaacaactttaattccaaatgtggtcttaatttccatttttcatgtaagttcacatgttcacatattccagagatgagtgtgtggacatctttgggaggtcaattattttcctgccacataggtaagcaataaacttcgcaataagctgggtgctgtggctcatgcctataatcccagcactttgggaggctgaggtgggtggatcacctgaggtcaggagttcaagactagcctggccaacatggtgaaaccccacctctactaaaaatacaaaaattagctgggcgtggtggcaggcatctgtaattccagctactcgggaggctgaggcaggagaatcgcttgaacctgggaggcagaggttgcagtgagccgagactgcgccattgcactccagcctaggcgacaagagcgaaacttcatctcaaaaaaacaaaaaaactttgcaataaataagcaatcaactttgtctcatcaacatgttatgttggtgataattggggatacagctttgacaagcaattagcacaaacatgacctacttgcagaagcttgtcatagctattattctaaatatggtaatagatgactgtaataatccaagccaagaattatgacattttaaaggcacacacactcttactcctgaaatatcctcaaatggacattaacatacaaatattttaattagattcttttaaattcttaagattatgtgatataacccaaaaatggggctgaaatgtcaggtgacaataacacccaaatggaggttccactcagcacttccagggacacccccccccaacatatatacactctttacagaaacatatttggaaatgaattcattattcataagtagttgtgaatagttagaaaatagattttacatttcacattcaataaaactcccacagaatgtcaattctcattattcgtggattttgtattttcaaatccaccttcttgctaaaatgtatttgtatttgcaaattcacccacctgctaaaatttattactaaccccaaaattcacactcacagcaccttttttgtcatacacagactggccaaaaatttcattctcccagcttgcacattcccagctgatgttgaacaaaaccgtgttctgccttcttgtttcaactctcatactaaaatcaagtgtccttttcacaatctgtttagtgtcgcggttttcatatttttgtgcttttttggtgattttgatgtttacaatggcccccaaacatagtgctaaagtgctctcaaagcacaaaaagaccgtgatgtgcattatggaggcacatgtgacataaactttgttcagatatgacctacagtgccattggctataatctcaatgctgatgaataaattttatatgttaaataaggtgtctttaaacagaaacacatataaaacaagattatgtcttgatcatttgatgaaaatgttgcagccagaggctcacagaaacttccccttacattttcccaagaagcaacaatttagtacttgctaatgttggagctctgaaaaccatatcctcaaaaatggcactttgacatgttgagtgctttgaattaaataaaattgaaaggcctcagaaataagcctcaggaccaacactctgtctaacaccatcagcccccccaaccccaccctactgtattagtctgttctcatgctgctgataaagacatacccaagactgagtaattgataaagaaaaagaggtttaatggactcacagttccacatggccggcgaggcctcacaatcacagtggaaggcaaaaggcacaccttacatggcagcaaccaagaaagaatgagaaccaagtgaaagaggtttccccttataaaaacatcagctctcatgagacttattctgttgcaggagaacaatatggggatatggggggaacagcctccatgattcaattatttcctactgggtccttcccacaacatgtgggaattatgggagctacaattcaagatgaaatttgtgtggggacgtagccaaaccatatcacctaccatcctctttctttcctgaagcaaggaagcaagaaaggagaggcttttgctgaagtttccttatctgattaagtctgaccaagggaggtttctccagaagaaatgcagtgtttttgtttgtttgtttgttttaatttagcccagtcaaattgacatatacaaatgcagggtttttttgtttgtttgtttttgttttttgagacggaatcttgctctgtcacccaggctggagtgcagtggcgtgatcttggctcactgcaacctttgcctcctggattcaagcaattctcctgcctcagcctcccaagtagctgggattacaggcatgtgccaccatgcccggctaatttttttgtatttttagtagagacaaggtttcaccatattggccaggctggcctcgaactcctgaccttgtgatccaccgacctcgacctcccaaagtgctgggattacaggcatgagccactgtgcctggcctgtttttttgttttttgtttttttttttgagacggagtctcgctctgtcacccaggctggagtgcagtggcgcaatctcagctcactgcaagctccacctcccaggttcacgccattctcctgcctcagcctcctgagtagctaggattacaggtgcccaccaccacgcccggctaattttttggtattttttagtggagacggtgttttaccatgttagccaggatggtctcgatctcctgacctcgtgatccaccctcctcggccttcccagagtgctgggattacaggcgtgagccactgcaccgggccagaaatgcagatgttttaaaactccctctctacagatcttatcatataaccaggaaagagtaaccaccagagaggagaaaataagtcattaccatgtccagacagacttttcatctatccttctgagggcagctcagagagattatgggaaagattttatctgcataatgacaacctttgtttacaatgaagttctggtctcacctttccataatttgcttgtacctcccccagagctcagacgaactttgtaccaggccaattgtcttttctttgagctcattcattttccctaaaataatttactttccctctagatgtgcccacagtcccccttttccctgtcccctgtgaataggatatttaagaattaaccaactagagggcatttaagccttaaccaaagcccttctttgagtctcatatttttaggacttccttctccatgtgcatattaataaattgcatgcatttttcccttgttaatctgtctattgtcagctcatttcagcagtgaactatcagagggcagaggggaagatttctctctgcccctacagtaatttgatatttacagaaactttatagaacataactactgtgaataatgagaatcaactgtatatgtcacctttgaatacctctcttctctcttcactgcattcctttggcacagagatggagccaaactctagtggctagggaagtaaatgaaagactgggtctgagtcacctgtttccctaaaggtagcatcaccctctgaaggtgccccttacaggcctctctgggaagggtttcacaatctcctcccacactttacagttggcaaattatggagccaagggccaaatccagtgcccatttgggcaacaagctaagaatgttttttacattaatgacaggctggggaaaaaaaaaaacagcaaagaaaataatatgacctaaaactgtatgtgacacataaagcctaaatatttactatctgggcctttacagaaaaagcttgctgaccccttctttgcagcctcaagtatagcaaatatctagtgtttgggaaataatttaaaacaaaacctgttcaggaaacctctccacaaaagtagaatagatgttgttgaataagcactaaagctcacttcaatgtgcatcacaagaaatctgccaaagagattgaaaaacagacagaaatctcaccctttcatgtggccaagtaggtagaaccctcacatacacgttctcaagattgatgataagttgtttgcaagtaagtaaaaggacttgacagcaccacttgccacatagaattcatcccagattcactgggtaattgaaattggccatgggtgcttgctaattacctttatccaaaggaaaaacaaattctcatatctttataccaggaggtagttttgcaatgtggagcccgacgcctaggtaacattaggttcctaccctcccatgaaaatgtcaataaaaagagtccaactttgtaacacatttgtagaaatttattctgagccaaatatgagtgaccatggcccatgacacagccctcaggagatcccgagaacatgtgtccaaggtggttgcagcacagcctagttttatacattttagggagacatgagacatcaatcaaatacatttaagatataagttggttcagtccagaaaagtgggacaactcaaagcaagggggtgtccaggttataggtagaatgaaaaatttcggattggcaattgcttgaaagagttttatcatagaaaacaatgtctgggttatgataagaggttgcagagaccaaagttttatcatgaagatgaagcctccatgtcgcaggcttcagagaaaatagattgtacaggtttcttctcagacctaaggcttgtgttgatgttaaatggtgattggcttttcctgaattccaagaggaaagagggcataatgaggcatatctgaccctccctccccattgttgtgggacttttccttagttcagctaaagatgcagtctttgtcccatggccacgaaaatttaggcttgcagacgagttgaagggtgagtaaagcagggttttattgggtgaaaaggaaaaaaaagggggaacagggaccctctgcaaagtcagagtctctgctggtgtgcttcctgccttgcagattgaatcccagtttccacacaggaagaggtggggccaggctcctccctctgcaaacagtgcaaacttctgtggctccaccccaaggtgcattccttccagtgtgggctggttgcagtttcactggggaccctctcccacctggctgtctcaccatcatggcctaaaccagtctttcaggttaaatttagggtgccctggcagaggaggggtccattcagatgtttgtgaggggtgtagggggtggctatgagttttatttttggtttataaagatgaggggatgaggtacaatcctccttggtgattctatctcagagatagttccagacccttgagaaacacattcctacattgtaaaacctgcaagagacttatcttttttctttaaaaaattgctatatccctaagaagcagagaaagaatttatgtttctaaaagaaaatattctgaggaaatggtggtggtggtggtggagatctctttccctttttccatcagggagaattattacttttttcttatgttccatttgtatttactgttacactagttaactaagtatctagccaaaaggaactataatttgagaaggtggttcccatgacttctcctctttcttttctttcagacttctgcttcctcagaaatgccctcattttgtcccaaggtactcagatctgtcactctacttgaatccaatcagcaaaacaacagctctgcagttagctgacttgcttctaacctccatcatctaaagtagaatattaacctcttatatcattattcaaaattgtcacctgggatttcagctcctattctaacaggtcaatagaatcatttcctgaagagaaacaggagtgtgtgtgttttgggagtacggaagatatttctactaagaaaaggagtttttctccacagtgttaacattagaaatctagcacttaccatttcacaaattgaatacctgaggcttagggaggtgaagtgacttccttgaaggagacaagtagcaaatgtggaggttcatgtctgcagcctatagaacccaggaatcctctttccactatgccagactaacctgggaacccaattagctgccatcaaaagtataagaattctttttatttgcctattatctctcatgataagtgaatcaatcacttactgagcacaattcctacaaagtgcaaaatgaccaaagtccccagagtagcttcctctacatcatgagctacaactccagtaaaagagcctggcaactgtcaaagacaaaatgcaccagactgtggagcatatgatttcattaggactatttttaatagagagaacatggcctgatctcagcaggttgtgactgtgtaactggtggtataatttactatcaaaattattctgcaatcaggggggtcttagtcaactcaacaggaaatgtttatctttggattttgttagttcggagggacaaacagttctaatcttagctaattaataatgagacaaagaatgggtggttggaggatctgtgttttgccttgtcagcagacttaggccaaaggggaaaggtctgtgtttgaccttgtcattagcaatgtgctaattgtgactcctaatggggatggagctgggtgtgtgcttggacatggcattccatatgtgcccaggacatgctgtctttttaagagaatataagaatctgaccgggcacggtggctcatgcctgtaatcccagcactttgggaggccgaggtgggcagatcacgaagtcaggagattgagaccatcctggctaatgtggtgaaaccctgtctctactaaaaatacaaaaaaattagccaggcgtggtggcgggtgcctgtagtcccagctactcaggaggctgaggcaggagaatggcatgaacccaggaggcagagcttgcagtgagccaagatcgtgccactgcactccagcctgggcaacagagtgagactccatctcaaaaaaaaaaaaaaaaagagaaaataagaatttaatttcttcagggatcctgagtatctctcattacctaaagtgttcatttattgccaaatgattaactttctatttatgtgtgaggtttgtgggagaccatagagaagttttgtttaaaacatctgtgtatttctttacataattcatttattatatcccttgctgaatgttctggctgagaaagatttaatttaaactttccatcaatgagaacaaagatgaggcttgctgaaatatgttgatgttcactggacagcaaatatcctgctctgttctatattcaaagttgaaaagtgatggaaacctcatcctcatcctcagggctcagaaaagtcacaaggtctttgactttgaagagtggaacaagagggcaacatgttttctagtaagtaaagtaagtgaggctatggagtaggtttcagagtggcaccttcaatcttactcagaaatgtcaaagtctttacaaaggcttcttctagacctgtaagcctagaattaatataaatgctcacctaggtcaaattcaatgatatttatcttaaagggctttcaaatctaagtgagtttcaataaggcaaacccttctgagtcttttatttccctaagcataaaattctatcttctctaccttctgtacttctcagcattagcaaaggaatctcatgataattgaattcaatagtagtttatctgatgccaactattttcccatctctatgctgggccctgggtacacaacaatgaaaacaatgtcctcctctccactacccaggctgccttctcctctaaattgaacaattgtctgtgattcaccaacaacaagaacttttctttacctacctacctaaaatatataaacacaattgacaacttcagacatgttctttcaattggaggacaattacaaatagttgtcctttgtattgatgaaaaggctagtggcaaggttggttgtggcctgggcagcaggctagatgggcctctcaggaggacttgctaggttgcagtgccccagagcaatttatgacataaaatctgtaatatttgagagataattgtcacatctgataatcaagatcaaataactgggttctccttttgtctgcaaatgatgattatgcttgcccacggtgaagctgaccttcgtgtcaaggagctcgatgaggatggaatcccagtgctggctgccagggtgagggtcattttggttgcaggcgagagtgatagaatgttaccaaaaagagaggaaaaacaaactttcaattatgacaagtgcaaaaaaacacattttttattttgaggtttagcatttctcaaaataattacagttacatgcttccatactacgtacttctctctcaaagattagttgtttggatttatctagggcttgaacacaatatcctatcaaccttgtaatcctttacatatcatttgtattgtttttagtcatttagctcagtttccattgaaatgttacctttgttcattattgctacctctaaatgtcctgtccttgtttttatgagaacggtgtgtagctatgttgttacattagaactatataaagagcattaaaagatgtacttatttcacaaattgtcaaaatataaacaaaatataaagcaaaagacaatagagatatataaacatagcccttaagagctgtagatacactcttttttgccaaagatttctatttttattgtagatttggagcgggggtacatgtgcaggtttgctacaaggatgtattgcgtgatgctgaggtttggtcttcaactgaacccatcacccaaatagtgaacatagtacctgataggtagtttttcaccctttgccccttccctcttttctgtccttcagattctctagaatctattgttctcatctttgtgtacatatgtacctaatgtttagcttccacttgtaggtaagaacatgtgatataaatatactcttaaattgttcaaagacaatgaatgcatcaaaaatatttccaaatgccttgcctgagagttttatctgagtgaaaagagttttccttttattaatcccaggttgatatgagctccactttgttctctgtggagtaaaatcctatctctctgaggtttttgtttttaacaattctcattgatttttattgtacatataaaaatgaaatcatttaagaagattcataatgacaagatatctgtagggtaaacccagaaagggttcaagctttatgacagcaaaggaaacagttaacagattgaaaaggcaacctataaaataggagaaaatacttgcaaactatttatctaataaggtgttaatatccaacatatataaggaaaccctacaactgaatcgcctgaaacaaatacccagatttttaaaaggtgtacagtacttggattgacatttctctaaaagaatatctgagtagccaacacacatatgaaaaaatgctcaatgtcactaatcggagaaatgccaatcaaaaccataatgagatatcactccccactggttgtcaaaacaacaacaaaaagataacaagtgttagcaaagatgtggagaaattggaatccttgtactctattgggagtgtaaaatggtgcagccactatagaaaacggtatggaggctcctcaaaaacattaaaaatagaactatcgtatgatccagcaatcccacacttggtatttattcaaaaaattaagatcttgaagacatattcgaactctcatgttcattgcagcagtactcacaatagccaggatgtagaagccgcataaagacccaccgacatatgaatagataaggaaaatgtggcatctacttacaacaaaatattattgtctgacatgaaatccttccatatgtggcaacatggatgaaccctgatgacgttatgctaagcgaaataagccaaaaggaaaatacagtgtgagtccgttattatatgtccaatataaaataaccccattcacagaagcacaaagtgcagtgggttaccaggggctgggagaagtggaaaatagggagttactgtttaacaggtataaagcttcaggtatgcaagatgaataagtcctagagatctgctatgtacaacattgtgcctgtagttaagaacactgtgttgtattcctaaaaatttaagagggtagctctcatgctgtttttatcccaatttttaaaaattagattgcatggaaaagaagatccttgcacatggacttttcctctttccataatttcaaattgcaagcaaattaatctgggatgatgacttatatttctcctccactataattttacttctgcctcaggaggatctcctatgaatttctgataacctagttttcctgtgcttctccgctcacaggttgtcctaaaatcctagttaatttacatgcttgaaattgcttgcatggtttttaaatttcaaataaataatacctttgattggactcatgggcttctgatcaaacccacagactttctttcatcaaaactaaacacttcagtagatcctagaaaaacagtgaaaactctccaagtataaatatgatgctgaataaggtgtttaaaatatatgaagctttacacatacacatacatttttagtatgagggtatctctggcctattcacttaaggaaaaacataccaccagaaatggaattccctttcagtatcagaggttaatatgttaaatcccattgttagctaacatttttctaaaatataccaactagaagtttgtctcataccctactctttactgctcctatcttacacgtatcattatgaaaacaaataaatgtccattttgtttccttttgtaaaaacatatgataatcaaaacatttggtcaacgtctactccatctttttgtttatttaaagacaacttttatgaaatgataatattggaaagttatgatatccttcagctagttgcaaagactaaagaaaatatgctactcaaggtaaatgatttgtaacccctgagcagagtcacagtctccctctctctctctgtctctctctgtctctctctctcacacacacacacacaccacacacacacacacattttagaatcttcaaaaaccacttccaatacaaactaggtacctgaagtaaagagatactcattttggctgaataaaaggcaaattcattttgtgtttttcaacttatttttagagaaagctttgaaatgacattacaagtcatgtcttttgcagccctgtcataaccatgtcactgtactttcagcttctcaattccttggcaagtcacatgcattgtcatgttgaatatcagtattttaaaagaacagctgtcaacatcagtggcatcctgaaaaagatgtacagagaagctcatattacccagaaaaatctcacactgtctttcatacttcagaaataaaaagggaaaaggaaaggtaattgccctttaaacatacatttatatagatgccagagaaaccaaataaaataggaagctatttttcaactgacatgttctaagtcaatataatggcattacatattttctcaatttgtttaatttgattttaaaagtcacaaacatttgaatctacgggtatgaatttcattcacattatatataatgtaaaatatttactttcatgattttaaaaatcttgtctattttgtgtagttttcttttgaaaatgtaatgtgttttctcacatcttgttaatgtacttctaaaaattcatttaccgagtacacaatgcgtaagcatcaaattacatctaaataatctgttgattggacagtttctcctcatacactacagaacaattaggcacaatagaaaaaatctctatgtcaaatataagtgattttaaaagtgattattaatcataataacataagaacaattggagcagggccttcaatattgtcacatttatgacagtacagttatctttgtgttacgagtatcttaaataagaacagtaaggttttattttatatgagaactatttttacaatttagctaattataaaaagtttgctttgagatatagtctagattattttggtatgttcttttctctttttcattttggctagtattactgttagattgtaacagcaatatttatcctccatggcatataacatctgccatttcagtcttccgaagtgatgttgttggggttcagaacacaatactccaacagatggcacctcggcctgctgaatactttgaactaaaggagattggaggcttcagaatcaagggcaaggtcgctgaccttctcctaccctcctgtctccctcccctctcattactctgaagctgaaaccagaattccttttccccaaggcaactcacagaaactagagcccctcttccccaaagcaagtcataaaacctagaaaagtcattcttttccttctcccttgaagactgtgtgtcccacagcaggagaaataaatgcagcttagaggccaggaagacaggtcttgctgggttctttctcagcctattaccatgagatcattcctttttgtccaatcacatttccacatggctgtcccttcttcatgaagcctacctataaaaatagatgatttccctgggtctttggttcttcatttttgaaagctcttctgatatgtaaaactttgattaaattgatttgctatacttttctttaaactgccttttgttataggagtactggttgtgacctttctgatggggaactttggaaaggtatcacccctttctgcccttactgtataaagagtaaacaggtagttgagacacagaacaatatcataaaatttcttttgtcctttagacaaggccttggctttttctccattgcgattttgatggactgcaaataaaaatggaaccttatttcatatattttaacataagactggccgggcgcggtggctcacgcctgtaatcccagcactttgggaggccgaggtgggcggatcacgaggtcaggagatcgagaccatcctggctaacatggtgaaaccctgtctctactaaaaatacaaaaaattagccgggcgtgatggcgggctcctgtagtcccagctactcgggaggctgaggcaggagaatggcgtgaacccgggaggtggagcttgcagtgagcggagatcgcgccactgcactccagcttgggcgacagagcgagactctgtctcaaaaacaaaaacaaaacaaaacaaaacaaaacaaaaaaacaaaaaaaacacataagactatccaaccatttctagactaaaagcagtgatcatgaagcagattctgctaatcggctgtttctatttcattagaattttttgcatggttaactgagattgtaactgtaattttattttttgtatttaatcttttaaaagtaatttagctttaatgttgtactcatttcataaaatgaattagaaagcttttatcagttttcaattcttcggaacagtatagactgcactggaattaacttctctttaaaggagcgatacaattctcttagaaagtagtggccacctaatattctgaaggactgacatttttctttgtcttttgcatggaagtcagtcaatttagacttttctaatttttataggattcattttgttaaattatattttcttggaaaatcatatactttattaagattatcaaactaatttgaataactaagctaaatagattcttacaattcttttaatttcctcattagctcttcttttttctgtttttgttttgttttgttttgttttgtttgtttgtttgttttgagatggagtctccctcttgtcacccaggctggagtaccgtggcccgatcttggctcactgcgacctccacctcctgggttcaagcgactctcctgcctcagcctcccgagtagctggaattacaggcacccgccaccacgcccagctaatttttgtatttttagtagagatggggtttcatcatgttggccaagctggtctcgaactcctgacctcaggtgatccgccctcctcagcctcccaaagtgctgggattacagtcatgagccactgcgcccggcccggcctggaaatcttatctaaaaagtagcaactgctggaaaaagggcctggggcctggggggcgggggtggttcttgtcacagcccccaggctcctgtctcagggatgaatgtggccttctcactgggattcttctcttgtccaaaagggctgcttttggggactaacaatactggggagtgggggtgaagccagacctagctcagggtgaggatttcggggccctggcgtactgaacacaccccacaccccaacattctcctccttctatctcttcctcttctcccgaccgcttttgtgccggggctgcgagctccctgtgttgtgcggtgactaaatcgaggccgagaagggaggctgccccccaaccctgtgggtcagtgcccctctgccaggctaggagaaagtgggtttacagcagccgagctgggggttattttggctggagctgctggagcagaaaggcaggagtctgaaatgctcggcagggtctggggaccttgttggacccgcctggtgaccggctgggctgtcgcgtcctacacgggagctccgggctttcatttctcttgtggtggggtggggattaactcagctattcccatggtaagcctgggtctctaattgggccctgggagccctgttaggccaccggcattgggggtcggtgaggaaggggactccccaactcccccgactcccaaccgccccacctccgcatagccttggagacccctgggggagggggctggggggcttctgagcccctgagtctaggttcactctcccgtcgggctgtgggaggggactttcacttgcctttgtctttggggacgggaccccactttcttctgatctcagggccattgacacacaccccctttccaggaggggttggtgggcagctaggttctccctgccccttcccggggccggcaccgtagcagcacaatcaccccgggaagggggtgtcttttcgctccaagacgcaatcgggccccactcgcagaaccgcctggaccctgtccgtgtctgccctccggcccccagggctcctctccccagagccgccgtcccgcgcctgggtcccgcgctgggggaagcgcctgctgcttatctctgtctacctcaggtctgacttttgatgccaaaatctaagcccctggggtgcctctcccccgcctcccgtgcaccagggtctgcagcagccactggggccaggctgcctgctgcatctggcggccctggaggcggccatgggcccctttgcacccgcccgccttggtgtctggggaggggctgcgcagggccgtgggctgggtcgtctctctcgggctgcgtgtgttgcgctcccgtgtgcacgtgtgtgtgtcgggaatcctgcgtgtcgtgcctgtgtgggcgatccggccccctggctgtgggtgggactggattctaactcaggggacttgggcctgctgttaacttcgatgattgtagggacaggtggggcgggcggtgggtgggcacggggctgggtcctgggcggcctggcgactccaggagaaggaaatcactgaaggcagtggtcgtggaaatgggagggggtcgcagggggtctgtggggcccggtcctggatactgggcaggaagccgtggtctccagagggtactccctgcctcaggtggccccattcaaccccagccgtacgcacctcccgccactgcctgtcggtgggggtttaaagttggggtggctttctggggtgcagctcagcatcccctcttatgcagactgggatggggtcgggcacctccctcagccacgaggaccctggacgggttcgagttctcttggggccgtggggctagctgtgtactgggcggggaccccacactcgaggccaagggggggctctccctgctgtgagatgttgggggacaggcagcttctggaaccttcagtgggacccttaagtggccgtcaggacaggcgggaggatgggcatggggcactggggagagccggggtcgttaagggtcacgcatctgtacagtctgaatttcctttatctttttttttttttacccactttgtccctcttttcccctaattgtgctcttgcattttttttttcttggcaaacgtaaactcagcctttcattcatgacgtgtgacatttcagtttctctggggtttgtcagaggacgcggggaccacgcctgaaagttaggtaatgggagaaaaaaaataatagactttaaaaaaataaaaaataaaagaatcataaaactactctctacctctggctgggcccagcctttcttgccctggccgcagcagggtggcctgtaacaatttcagttttgcagaacatccaggtattgaaaggaaaaaaaataaaaaaagacaaaaagaccagaaaaaaggtgtgattttgaaatttaaaagaacactgaaagtttacattttataatagcattattatgcagattgtattttaacttcagaaatatttaagacgattgtaaccctgtaaagctgataagatattaaaacgagacaaaacacttcttttaacaggaaaaaaaaaaagaaatttcttctgtcagataacctaaatcatctctctcaagttcaaagttccacaaatctctagggcaggggcaaaatgctgccagtctctttgctaaaacataacaagagtcacttttgctccagttcccaacaagttgctcatctccatctgagaccacctcagcctggcccttattgttcatatcactatcagctttttttgtcaaagccattcaacaaatctctgggaagtttcaaactttcccacattttcctgtcttcttctgagccctctaaactgttccaacctctgccttttacccagttccaaaattgcttctgcatttttgggtgtcttttcagcagcactccactctactggtaccaatttactgtattagtctgttttcacgctgcttataaagacatacccaagactgggcaatttacaaaagaaaggtttattggacttaacagtttcatgtggctgggaaagccttgcaaccctggcagaaggcaaggaggagcaagtcacgtcttacgtggatggcagcaggcaaaaagacagagagcttgtgctttattttaatttttgttgtgcatatatgtgtatgtatgtatttatttttttttattttaagttctgggatacatgtgcagaacatggagtttcgttacataggtatacatgtctcatgatgttttgcttcacctatcaacctgtcatctaggtttttaagccctgcatgcattaggtatttattctaatgctctccctcccctttcccccaaccacgacaggccctggtgtgtgatgttcccctccctgtgtccatgaggaactcctctttttaaaaccatcagatagtgtaagacttattcactatcacgataacagcctgggaaagatttgcccccatgattcaattacctcccaccaggtctctcccacaaaatatgggaattcaagatgagatttcggtggggacacagccaaaccatatcaagtccctagagtgagtaggtgggtggagcttataattactggattggaagctcatcaatatcttttaagatttatatgccataatttgtccagcatctgagtactttgtagcatgaaatgcttcatgttacaatgaagtattagtctcacatattataggcgctgtcttcattttctgttgctgcataatgaattaccacaaattctgctgcttaaaataatacgaatctattatctcacagttttagttgcctgggcacaacaatttaggtgttgtctgaggtaacttagggtttctgagtcatattcctcattttcttctgtctttcttccactgcctaattatgaagccactcctagtctcaattataaaatctgtctttgttttctgttgctgtactgccaattactacaaatttagcaggttccaactaagccatttataaattcatagttttgtaggatagaaatctggtgtggtgaggccagttgcagtggctcacacctgtaatcctagcaatttgggaggccaaggcgggtggatctcctgaggtcaggagttcaagaccagcctggccaaagtggtgaaaccctatctctactaaaaatacaaaaatcagctgggcgtggtggcgggtgcctgtaatcccaggtacttgggaggctgaggtaggagaattgcatgaacccaggaggcggaggttgcagtgagctgagatcgtgccattgcactccagcctgggcaacaagagtgaaactctgtctcaaaaaaaaaaaaaaagaaagaaagaaaaaaaaaagaaatctggtgtcgcttgcttgggttctctgctcatcatctcacaaatctgaaatcaaactgctgtgggctgttttcatctggaggactgagcaaggaagaatctgcttccagcttatcagcacaattgagagaatccaattccttgtggttgtaggactgggatcctgtttgctcactggctgtccactgaggccactgtcacatcctagaggatactgtattccttcaaaactgcaatagcatgtcaaattcttcttgtgttttgaatctctgacttccttttttgacatcagctggagaaaattttctgctttgtaaggactcatatgattagaaaaatctccccatgttagggtccatccagataatctccttatcaatgaatcaggaccttaattacatctgcaaaatctctccacagcagtatctatatcagtgtttgaaaaactgggagtaggtgtgtatacaatagggtaaaaaatattggccatgggcagtgggaggaggtatcttataattctgtctactataaacaagttgtttcctaaaattttctcttgagttgatttaatactatattattttattttgaggggggcaaaagatatataaagtattacaaatattaatttactcaatgtaaatttggagtgccattaattgttcctcatggcctaaaaggcttaaagccctgataataatctcattataataaacaactttgcaatacactgaattggtccactgacctttgtttcaattcatatgtcttcaaaaattcatccctcaatgtaaacaatcataatagtctcgacagtccagaaaaatggtgtaaatggtgtacaaacttcaagaagagctgtgtgtgtctttgtgtgtgtttgtgtgtgatcacaaaacctagatatatgttaacatgaaatattatggaagaaaattaatttaaggaagtgaggtggaaatgcaaacacagaaaccaaaagatggaactgtccccacaaattttagaaatagattgtgttctaaacatcaaataaaatcaagccatagaaaggaagaaaatcttaaatacacaagtaaaatttgctgtttttctctcagtctctatttattttgttttccacatgctttaagttgatcattgtttcctttactcagcaatgcagaagagatgagtgataggaagaaattaccatggcaaatcatgaatagactgataacagctagtgactactttgcaagtagttatttgaaactacttgcaaagtagaccgggtaaaaatttatataacaaaatgcaaaaattgagtaattaaccgctgagttataagaatttgacttaaccctgataattcctgttgaacaaggacattgcgtgttcttctattaattccttaatcatgacttgtaggttgaaaatgagaaatgcttcttcttgatagataaagcacagatcttatagcaacaagaggaaagaactatgggccaaattttcttagctatgcttgaagtaaactttgacaactaatcactttttattttatttaagaattcccaaccaggagtaaaagtccaaacctgacttataaggcatataatttaaaaaataatactgtgaaataacttaatacaaataacaaaatgttgaaggtaggcatgttaaatccacactatcagattgggttttaaagagaaggagaggagacatcaagcatttagaaatcaataggaaaaagattgttctatttttataccataatgcaaaggaggcagagtgattttaagaacactgaagttaaaagcaattaacttggtaaaataaaatataggtaggtagataatcagatatatgtaaaaacaaacttcaaaaattattttaacatcataattttagataaattgaatcagtggcttattcttgaaggtatagtagcaaatgagatgactgttaagtaactatcaaacaactttttgtttgacatagttgaagtcagtaccatctgtgtgcaagagacaccgttcctatcacacagatagcatgggaaacacctgcctgcatgattcaattacctcacaccaggtccctcccacaacaagtagaaattcaagatgagatttgggtgggtgtgagaaatctactcatccatccaaacccaaagaatggacttagaggcatgaagaacagcgaaagtgagacttaataatggtcttgcaagattgggtgtctggtaggtaggtacatctggggcagtcacaacaagtaatttatcttccagtacgcaagtccctccccaagttcctcattggttgagtgctatggggttacaattttcctggatgtcacctaagtttcattatcccccttataaggttatatcccggtcctctttcttgcttgtttcaatttcccaataatgaaacttttttcccttttatgggctaacccctccttttcattgtttgcttactgtgaccttctaggtgcatgagcagtgcggtttgttaaatttgcaggctggcttccagtacttttgatttatcatgccttgaaaatggaccatttaaaatggtttctcataaattccctcctcttttctatttacttccttcggtcttctttttatttaagcccttttggtctttgaatcactggggacacagccaaaccatatcagcatttaaacactgtttccttattatgtaatctggataataaaactcgctctttctatattatgccacataaaatggaagtatagatgtgacactgtcattaaatctgtgaattatatgtcattatgtttctaaaacacataaatcgtagtgaagttattccatctcagagacggcccatttaactataataaacttctaggtattcattatatagtgtattttttatcatcaaatcactgatcagatattttccttaatgatttattcttccatttgacaaatagattttggggcaagttctttgttaggtgttggcgtgatagcagtgaagaaaattcagcactcggggaccctgctgtctaattgggaagagcacatcgggggacacacagacatgggaacgtgcagggtttttagaactgagagacccaattgaggctctcagcaaagtcatttttcaggaagtggcatttaagctgagacctaaatgatgatttgtagtttgccaggaaagaaatccagagagggggaggggagaccacataagcaaagaccttgtgtcaggaaagaactttataccagagacgaatggaggatgagagtggaagtcagaaaggcaggggctaggcccggtgcggtggctcacgcctgtaatcctagcactttgggaggccgaggcgggcagatcacaaggtcatgagatcgagaccatcctggctaacgtggtgaaaccccgtctctactaaaaatacaaaaaaattagccgggcgtagtggtgggcgcctgtagtcccagctactcgggagactgagggaggagaatggcgtgaacccgggaggcggagcttgcagtgagccgagatggcgccactgcactccagcttgggtgacagagcgagactccatctcacaaaaaaaaaaaaaaaaaaaaaaaaaggcgggggctaagtcactgaggcctgaggctgcacagggagctggatggtgtctttggaggaaacgaagacaaagaggttcaaagctgcttaaaggtcttgcaggaaagtgataaagtcagatttgcatcttttgaaaggtcatgttagcatcttttaaaaggtcatttataggagtctgccccagtactgcactgcatatgccacattgattaatggcaaacaccacttgggccctatttcttgcacatcgaacttgtaatacagcatgctctgtcatgatggggacagtacgagatagttcattatgggaagacatgagaacctcctttatcttgaacatgagatggagatgtggagatgtcaggaaaattaacagaaagcaagcgacttctttactgagatctggagaatgaaaagaatcaggtagtaaggaaatgataggtgggtgtaaagggaatgtggcaggtgtctgaggtggtgtgggcagagcccatgaagctagaaaaatcattcttgttcagagcgaaaattgattcagtgtttctgaatagttgaatattctgctccatgaactgcttccgagtctggaaggggcatggaatatgagatgacattgaagatcaactcgggcataaagaatttgggatttaatccacaggcaaggaggagctcttacagtatctgaggggcacatttaagagcaagacagattatttttcagagaatctgctgtacattttggaaggatacccctgactgcagtgtgattccaacatgaagggacttgaggcaggtggcgtacataggatgcagaaacttatgccaaggatgatggcaccctaagcaagatgccagccatccagacagagaaaagtgggcacactcaaaatgtattaagaatgtggcatccacagggcttagagtgccactgagcgtcaacagtctggaatatgtgttttagcaactgataggatgttgctgtcaagatagggggcgctagagaataagacagctttggacgagaacaaaggaggtaatactggtttcaaatagactgagtattgcacgcctgtaatccgggcactttgggaggccgagggtgggggtagatcacctgacgtcaggagttcgagaccagcctggccaatatggtgaaaccccgtctctactaaaaatacaaaaattagccaagcacggaggcagctcacctgtaatcccagctactctgaggctgaggcaggagaatcgctagaacccaggagacagaagttgcaaaggttgcagtgagccaagattgtgtcactgcactccagcctgggtgattccgtctcaaacaaacaaacaaatagactgagtattaatggtccgtggctcatgcaagtggaggtgtctggttagcagtttgatatgaaagactgagctccagagagatctcataacttgggaatatgttttactccatacatattcaggtaagactaaagatcctgggattttggagtcatgggggaaagtgatattattcctgagcacttgctaggaactatccccaggttgcctcaggaccagcccctctcgctacagtaaccccataaagcagtgcctacactttacattttacgggttcgaaaccagctcagtgggacttagttaaccgcccacagtcaagtgtcagcatcaaaactggagtctcacccaaagccagctgaccccaaagctcacactcctgtaagatgtaattgctcaagagatcttagacctcacctgatccaatctcttttctttccccgctgagacggagtcttgctctgtcacccaggctggagtgcagtggcgtgatcttggctcactgcaacctccacctcccgggttcaagcgattctcctgccttggcctcccgagtagctggggctacaggtgtgtgccaccacacctggctaatttttttttttttgtatttttagtacagacggggtttcaccgtgttagccaggatggtctcagtctcccgaccttgtgatctgtccgcctcggcctcccaaagcgttgggattactggtgtgagccaccgtgcccggcctcctcgttttctttaacagatgtttttggttaaaactcctgagttgatttgttttcattactcaaagcataatacagcaacgataattaagaacaaaggctccagagccttacaaagctccctgctcactgaacgtgggctctgggtgaaaccccttaacctcattgtgcctgagtttcctcatctggaaaattatgagttctcacttcagagagatgcactgagtgtgcatgcacaataagtgctgttttatttttattaatgtacatatttgtagaccacaaatgcatttttataaaagtttcaaacaatgtctaagtttagctaataaatttctctaaacacacctgtgttgtctggctgcattctagcatcaatggaatattactttatgcattattatctgacttcctttcttctctcatgtcatttctgtcttggtgatctctccgtgtcacgccgtagctaggtttctctcctactttctcacagctgcaccctgctagatagcaaggattcagaatgatttttctatccctcactgataacattctagagagttgtcaggtttttagaaattattattacaaacagtgccgcagtaaacattctactacatattagggggatgttttgtccttatttgagaatttctgtaagaaaaatgcctatgttctaacaccggatgtaaaacatatacatagattacgctagagcaagaggttcatatactgagtgtttctaaaatattttttgatttaatagtttattactttcattgtataactgtacatgctccaagtacattctacaggaaaatctcaaacacttcaggaaagcagtaaacattaccataatgtgataaaattggtattttattaattttaaattatatttctaacacataagccatattacccttgacaaggtactctcgttaggagtcagacaaatttatgaatgtgtgcaatctctattctatttctgtctaggactatatttctttaaaaactagtagctcacattcttaggaaactaagatagagaaaagaatagaggttttcaagttggaagatcttaatcagtgtggtttttaaagtttcaccttattaagttgaatgaacaatgggagatcacagtatcaattattcaaaagtgattaatgcaggttaaatgccaacaggctggaagagcacgtaaatgcatcgctaacctcttagcaactataaagatttgtttgtttacatatttcaccatatggatatcattgaactcttcagccttataatggatattttgtgaataaaatattattttgcaagaaataaaaaatagtgtttgtcttttagcattgcacggttgaggctacatttactcaatagttcaaaacaggtaatttagtgctaggaatatcatctcccctgagcatagctgcaatatgctctatacacagggaactatctgttttaagatttggtataatggggcccggctcagtggctcacgcctgtgatcccagcactttgggaggctgaggtgggcggatcacctgaggtcaggattttgagaccatcctggccaacattgtaacaccccatctctactaaaaatacaaaaaattagccgggcatagtggggcacgcctgtagtctcagctacttgggagaccaaagcaggtgaatcgcttgaacctgggaggcggaagttgcagtgagccgagaatgtgccactgcactccagcctgggcaacacagtgagactctgtctcaataaacaaacaaacaaacaaacaaagaataaattaaaaagatttcatataatggggcagctgcttttaactggaatgcaataaatcctcacatactttcgaaagactgactttggtgagatagcatgctaggcatagagagacagggacctcactttcaggactgtcacaactcagtgcctgacacaggcatgtaggcaaacctcatgctgggaagttcagaaaagggaggaaagaacgtgtggcgaaggaggccaggaaacactccatcttacagctctgtaaatcagaggtctgccacagtctttctgggctaacgtctgtgcgtcagtcggactatcatagactcaacattctttaaagacctgaaattgcaaattattttatttcctggagcaaaaccaggtgcccatcacccatccatcacccaacacacatacacttcttttgcaaattgctacagttacaacaaagttgtggtcaatttgcagtaacaattaaagatgtccataggtgtgaagagctgaggtaaggaaagtcacattctccttatatgagcctgactcacaaaggacttactgtgaaggaaggtgagagagtcctggagaggctacatgagattgctgagccctttcagaacccacttctcaggcattgctggttgcatgaggttacagtttattggacctgccccattacctggtggagcgacctgtgcatctcttcgaatctcccagaaagagatttgggctcatggggcctgagggcctgagaggctgctccataagagctcagtcttcgcaactcacttcaggcgctactatggacactatggagcacttctttttttgttgctgttgagttttgctctgtcacccaggctgcagtgcagtggtgcaacctcagctcactgcaacctccacctcctgggttcaagcgattctcgtgcctcagcctcctgagtagctgggattacaggcatatgccaccacacccagctaattttcatttgtttttttttttatttgtttgtttttttgagacggagtcttgctctgtcgcccaggctggagtgcagtggcgtgatctcgggtctctgcaagctctgcctctccggttcacaccattctcctgcctcagcctcccgagtagctgggactacagatgcctgtcaccaagcccggctaattcttttttgtatttttagtagagacggggtttcaccatgttagccaggatggtctcaatctcctgacctcacgatccacctgcctcggcctcccatagtgctgggattacaggcgtgagccatcgcgcctggccaattttcatacttttagcagagatggggtttcactgtgttggccaggctggtcttgaactcctgacctcaggtgatctgcccacctcggcctcccaaagtgctgcaattacaggcatgagccaccatgcccaggcactatggagcacttctaaggacttttgggctttggagaataccaacctagcagaaatggttccttttggaaaggacattggatgacatcaaatgctcagcataaagtatatgctttgggtacctgtcactcttctaggtgaccctcatgaaaattgtatgaggaagttattgtggagaagcgatgaggcagggtcatagagagaacagggactaagagggtgcaagaagttggggaagttgcagagctaggtgacagaggagcagagcagaagaaaaagcctcggtgttgggagaaaacatgaagaaaaaataagttttgtgcttggtcctatgatatgaactgcctgatgctggtggcatgagggaaggttgctttagctataaaggtacaacatccatcaatattccacagtactccacattgcctttctccaagcactctccagagaaacagacaccactcatcagtgggagaaaactgaaccattttgtagaagaatctccaattataaagagtaaatgaatggatcctttttatacctcagactcctgaccacattgcatctcgacaatgatgcaccttgtcatcattgtcatgtgacagtttttgaatctggtgtttttctttctgcaatagtaaggccaatcctgcagggaccgaagtctgtgcaatcactgtgaaacacagctggaaataaggcaggaagaacttacagagctcaaacgtgcccatcagaatattttgaaacataagttacagtataggaattctcccctaaagtctccaaactggagtgagaacagctgaattactttcataatacaaaaacattcacagaatctctatgaaattatgaaaattaaattctaaggtgcattttcataaatgaggtggttgctgtgtttattttctgttgctgcaaattttgccacagactcactggcttaaaatgatgtgcatttattatgtcatatgtctcccgatccgtgggagtctgcctggggtctcgtgaggttggattcaagatgttgcctggatacattctcatcttggaggctcggccagggaaagagctgcttccaagacccctcaggttatcagcagaatttgtttccttgtgattgtataactcagtacgcaccatcttcctagctgccagctgcggacccctctcagcttccagagattcctctcaaggcctccccacgcggcctgtcatctcagcagcagagaaactctcgcatcttcaactctctcaggcttctcacctctctgacttcttcaaagctctgattaagtcaggtgcacctctgattaagtcaatgcattcaaataatatccctatcttagggacaattgtgccatacaaatgacctaattacaggagtcaaacacattatattcatggttcccggggttaggcagtgtttgtatgccaggtggatgggatatcgccttgggagcgccatctttagaatcctgcctaccacaaatcccaattctataacacaaaaggcctgagggcttcagcactatcacagcaggaggtataagtttcccagatacccaaaggtatccgctgtctgtctccacctaacatcccatgttcataccaggtggtgaaaaatccactcgtcatccataccattcagaagcatacagcctggattttgtcattctagttcttgtcactgtgtgtttgagcacatactagctagagaagctctttcatcatcagctctacacagtgcaatcctcaaaatgcccaccgttatccagaggttaccaatctctctcttttaattacacttaaactagcagaaatcttcttcatatcattaacccaaatggagaaaagaaagctagaaaattatacatctatttttccaccaaaagaaaagaaaaagaacattttcctcccacatttattgtgccttcaagtggttatagcaacctgttaagatcagccagtgtcgttaaactgcttcccagcgaatacagccagtgaagctgaaagagataataaagtttcttaggagaccgactactacactggcttgacacttgctccatacagaagaaaaaataaatcagtagttacacctccagcagctactgactagacatccttgcgttaagggtggaaattcaatatacaaagaagcaaagtgttgacaataaaaagaaagtaaaaactgaaagaaaattgtaattggattgaatgtggctaaaatcaagatatgaaaaagcagaaaacaaagccaattcaaactctgaagaaagaataaatgagaaaataaatgaaaaaaattaattggctcagcaagtcatgactagaaaaaattaacattattaaattattctaccttcgggcatggaataaaatgaagatgtaagtattcatgttaatttcagtctatttctgaatggtaaattgctttctccttcttcctctttgtatgtttaggtctgggaaatttgtttggaattagcaacctgggatgaggtttattaagacagaatgactatgagcttgcctgcaaagtggccgctcctttcttcccttcttttccatcaggtcattcgcccactgagaggtggtatctatttctgtacccccatgaatctgcatttgcagattccaagattaggacataagaagctttttagcttttgcctgggtctcgtggaatgcaggggaatctggggaaagccaagctctctacaaaaactctgactagcccaagactgtcatactgtgaggaacctcaagcttgtcacatggagaggctgtgtggagaccaagttacctgaccagctcctagctcttcaatccatagcattccaggtgccaggtatagaggtgcagaagctttctgacagcttcagccttgtctgccatctgaggtgccacaagtgagaactaatctggagtaatcaacatcaccatcccctgccatgaaatcaatgcagtgtgttcattcactaaattaggaggcagcttgttctatgcagtggtacagaacaggaacaatgatgcttagggctggggtatgggttgtgagggaagaaattccatgtcagcaaaacttcagagcatactacatcttctgtttgtttgtttgtttgtttgtttttgagacagagtcttgctctgtcacccaggctggagtgcagtggcacaatcctgactcactgcaagctctgcctcctgggttcatgccattctcctgcctcctgagtagctgggactacaggtgccagccaccacgcccagctaattttttgtatttttagtagagacggggtttcaccatgttagccaggatggtctcgatctcctgacctcgtgatccgcccacctcggcctcccaaagtgctgggattacaggcatgagccactgtgcctggcgagcatatgaaatcttaaaggtcacgcagctgaatttctgagcttacgaaaaggaaaccaggtactcaaagaagctgtgacctgccaaaagtcacccagcaaattaatagtggaaccaaagtaaaaatcaaattttcagcatgtaatgtccttacaccacgtaaaaaaggtttgggttccttagtttgagaaacgtcaataccccttcataaatcaagggtataaactttgcagaaaaattaaacttcttaccacctggcatccaaactggagtgagaacagctttgccacatctacattcccactcctactcagaagacagactccaagaagcataaaacttctggagtcctggggtaacctgagcaaaacccgtgataggtttccaggaagcaagggcgtgagcaggggtggagactgaagccccatccctgcaagggtccactctgaacctcaaggcccataatcctcccccatatttctctgctctgccatttttgggtgctctgtcaagtcccaaacccctcagtaagtctgtcttttcttctactctaagcacctctattcttctagctcaccctttcactgtggtcctgccttccagctctttccttctgtgccctctgggaactcattacattttcaaaaaggactatctcaacatcatcacagaatgcccttgtatagcatagcgtttgagagtatggcttggaagcaacagtctggatttctaatgcagactccaccatttaccagtcacaaaccttaacaagtcacttaatgtctctgaacttcagtatcttccactgtaaaatgaaggtatccattgtgaagattaaataagatgatgcccataaaatgcacaggctaatgcctggcacacacaaaaaataataaaacaacaaaaaaagggttgactatacatcctcaactccactgaagcctagaccaccattttcaatgcccttgtagaactcattacttccatagtttgtctaccatagcatcaggaaacatttctggtaaatttccatcaattcctggtcactggtgttcataaaaagcagcaagtaggctaggcgccgtggctcaagcctgcaatcccagcactttgggaggccgaggcgggcggatcatgaggtcaggagattgagaccatcctggctaacacggtgaaaccccgtctctactaaaaatacaaaaaaaaaaattagccaggcttggtggcgggcgcctgtagtcccagctactcaggaggctgatgcaggagaatggcgtgaacctgggaggcggagcttgcagtgagccgagatcgggccactgcactccagcctgggcgatgcagcaagactcagtctcaaaaaaaaaaaaaaaaaaaaaagcaagcaagcaaacaaaatgacaatctcacttatccttttagacaaatatcagctgattacagcaacctctaccatttctagcaagtgtcatcttccaaatgggtcattttcttacatccatcaccatcttctcaattcctcaatcttcaatttccttgtagatgacacttaagtgctaggaacttgcaattccttcatgtgtaaatgatcttcactgttgctccttttcagcacccatgccatggacgtacttggaacttctcatgacctaggatggtaccatctttttttttttgagacggagtctcactctgtcacccaggctggagtgcagtggcgcaatctaggctcactgcaagctccgcctcccgggttctcgccattctcctgcctcagcctcctgagtagctgggactacagacgcccaccaccacgcccggctaatttttttttttgtatttttagtagagacggggtttcaccgcgttatccaggatggtctcgatctcttgacctcgtgatcagcctgccttgacctcacaaagtgctggaattactggcgtgagccaccgtgcccagccaggatggtactatctttaaggattttttttttttttttagacggagtctagctctgttgccaggctggagtgcagtggtgtgatctcggctcactgcaacctccgcctactgggttcacgccattctcctgcctcagcctaccaagtagctgggactacagacgcccgccaccacgcccggctaattttttgtatttttagtagagacggggtttcactgtgttagccaggatggtctcgatctcctgaccttgtgatccgcccacctcggcctcccaaagtgctgggattacaggcttgagccactgcacctggccgcatactttttaaaataataaattatccaatactatctaactatggagactatcattgggttcattcataagatatagtgaccttaaccccattcattcaaaccatatcagattctctttttttagtgcattgaaacattattctttgccaaccttctgtattgataaacatcaggatggcaccaaaaatctaaaatatgcaattctataaaatgtggcagttgtaaatgtgaatttggtgggaacttaatacctgaaccattatttcctcagttggcaaagtgaagttgtttcctcttctttatgagattgcagcagaaacatgcaatttaaaaagcaagagagaattagggatcactcaggcccaactcgattccaccataaccctcatttttcaaccaaagtaaaagaatctcatgcatgttgcgtgactagctgttggagatgttcttgttaggaccccttcatgagtagtaccatgtcttctggctctcggcctgctgctctgtccacatgacatagaagagtcacaacaaggtgacagacagtcacaagtgctgcaaaatcattgaacaaatgaacaactgtgggttccttttcagttactagcaaaacataggtgcaaaactaaaattgttatatttatatttataccattaataaatgttataaggttataaacatcatacaatgtatgagggattcctgtcatctttcttataaacccactgtatagatgctttcccgcacatgctgttctatcagagacccttttcctgtttctgcctgccttcttgatctcatccaaaaggtcagaagagtctggctctcacctgcaggttcagggaagccccagtagcacactcatggctttctactctctcctattctccactgcaacttaaagatccttcacatcttacctcaagacaacaactccatggtcacggcaaagcattaagtataactactatatattttttacaaatatactttaaattatctcatatcaatgaaaagaaacacatatatggagtaaaaaaaaaaaaagtcattcacttcacaccactggctctctcacttggggatcagggaacactaatttcttgaagatccttccagaaataatcctgtacctttatatgcatgtatatgtataaatcttatttggaaatttcaactgagaacatattttggggttcccacgactacatcatggtcatgatttgctcagtgattcaccggaaggactcatgtaagtcaaaaagttatgcttacagctaagatatattactgcaaaggatactgtgcaggaactgtgagacacatattttgcatgcataagcaaagactagagaggtcaggcccaggtttccacgttccttctctcgcgagaattgtgcagacacgccctttctggctgcaaactgtggagatgtgtggcaggcatctccacctcagaaagtccgctcattagtgaccagcctgcccaacatggtgaaatcccgtctcttctaaacatacaaaaaattagccgggcgtgatgacgggcacctgtaatcccagctactagggaggctgaggcaggagaattgcttgaatccgggaggctgagcttgcagtgagccgagattgcgccattgcactccagcctgggcgaccagagcgaaactctgtctcaaacaaacaacaaaaaaagtccactcaaatctcagaatccagagttcttaaaggctgctgatcacacagctacccaaccagccaagttgcagatgccaaacaggcaccaggtacacatcattaattttcatgtttaaacaatgctgtcagcccagtacatcctgacccactgcctgggccatagagaatacaatcttaatcactgaccaagcgaacattcctgtcgttagttctcttcctgtggctccaagctttcccagagattaaaaagagctgagtaaaacaaacctactgtagtcactttttatgcacggagcacaatatgcacactattctgtattttgcctttttaaaaagcaatatatattaacgttatcagtaaatatgaccttattttttcatggctgcttgttattctggggcatggaggcactattatttgcttagtcagccacctattgctggagaactggacctgtactatttcactgttataaaaattgatacaattaacatctccatttagcgggggatatgagtatttctcataagaatcaccatttagaaaagaatgaatatggccggtcttggtggctcatgcctgtaatcctagcactttgggaggccaaagcaggcggatcacaaggtcaggagttcaagaccagcctggccaatatggtgaaactaaaaaaaaaaaataaaaaaaaaaaatagccgggcatggtggcaggcgcctgtagtcccagctactcaggaggctgaagcaagagaatcgcttgaaccagggaagtggaggttgcagtgagccaagattgcaccactgtactccagcctgggtgacaagcaagactccatctcaaaaaaaaaaaaaaaaaaaaagaagaaaagaaaagaatgaatatgaaagtggacttatagtaacccaccagcctccttgtggattgccttcttccactcagaaaagttgccatttatttatttgtatgacattgccaattatccctcttgtgttatttttaaaattttcccaccagccgtctaaatgactgtcacctactccccacaccctaaggcagcaatttctgatttggaaccatgggaatttcactttcacaatttcatctgccaacatgcaataacatctgtctctatgctgatgtggttgttcatctgggcctgggtttaaatctctgtaccaccttaactagcaaagtgacattatgcaactgacaatctcttgtgatttttctgtgaattaattgaatatttacgtgtaacacaccaagtgttctgcaaatgctagctttactggtttatttagtattctaatttaaattgataaaattctttttatgattgtcttctgctaagcagtaatatttaaggctgatgtgtgatttatatattattccaagacatataactacaagaaatatgcttttcctatccataattttaaaagcactgtgttaatcaacagaatattattaaatatttggacagtatcagtttgaaaagttaagtgaagttatatctcattgctgtgaccctttttttgtggtacgttcttcaaggtaaaaacaaaatatgtatcaatcaaatgaaacactgttttgttctgaatgttaaatttgctttgagtaattgcttattgtttttcttctaaaataccatattcccaggatgttctaggaacttctgtttggcaaaagtaaaatccttatcacatgaagaacctgcacggtaggaaagaaaattatcttacagtttaagttgtcagtgaatttgaatagtaatgcccaacttgaactcatgagaagtagttaaccttttcaattagagttctgatgagtttttaatataagcaataaatccctaattattattatagaaagcacaaattagggaaaaattacagtcctcaaagacatggctaaatctaaactcttaggtgcctggaaattatttactaatagaagtaattagagaagaaacctggtgctttgttccactacagcgatagctgctgggaagagggcacctcttggatgcatagacatcagggagcagtgtctggagctgggttctttttttctgagatggagtcttgctctgttgcccaggctggagtgcagtggtatgatctccgctcactgcaacctctgcctccagggttgaagcgattctcctgcctcagcctcctgactagctgggattacaggtgcctgcctgccagcacactcagctagtttttgtatttttagtagagagggggtttcactgtgttggccaggctggtctggaactcctgactgcaggtgattcacctgtctctgcctcccaaagtgctgggattacaggtgtgagccaccgcgcctggcctggagctgggttcttaaggcccatccaattgcagggataggcagtaggtcagggtggcacatgaacacagtttggaaaagtctacacaatttcagatggctgaaagttgaagtaaaaggccgaaattaaaccagtctattccacagaataaatgttcttgttgatatttgaagtgcacccaagaagtacagagttgcaaatgattcactaaatttacttcattctgctccaagtacctaagggtacaaggaattggaatcttctgccttcctttttagggggcagatgagaaataagagaaagggaagcctctgagaacagggaggtagaagggagagcaaagggtctgttgtaaggggtgtgggagagacagcagatttggaagcagggtacatccagccctctctggccttcttggatgagcctctctcctcccatctttgggactacaatggggattacctcgtttttgtttttttgaagaaagcatggttacatttgtcttatatattttttaatttgtatgaatttatgggtaacaagtgcaattttgttacatgcatagtggtcaaggcagaacttttagggtatctatcacccaaatgctgtagattgtacccattagtaatttctcatcatccccccacaattctgagtccccactgcctatcattccactgtctacatccatgcagacactttttttagcactcacttatgagcgacatctttctatatctggcttatttcgcttaagataatgacctccagttccaaccatgttgctgcaaaatacatgatttcattctttttgtggctgaatagaattctatcaggtatatataccacatgttctttatccagtcatccactggtggacccttaggttgattccatatcttttctattgtgaatagtgctgcaagaaacatgagtgtaggtacctctttgatatattgatttattttcctttgagtagatacccagtagtaaggttgtgggatcgaacagtcgttctagttttagttctttgggaaatctctattttcaataaaggttgtactaatttacattcccatcaacagcatacaaacattcctttttctccatatcctcaccaacatagcagatgagacattttatctttttaataatagccattttaatgaagatgatatcttattatggttttaatttacatttctctgatgattagtgttgagcattttttttatatgcccatgctggccatttgtgtgtcttcttttgaaaaatgtctatttatatcctttgaccacttttaaagaacattatttgttctttttcttttttttttttaatttttttttttagacagagtttccctctgtcgccaaggctggagtgcaatgtggagtgcagtggtgcaactttggctcactgcaacctccacctcccagattcaagggattcttgcctctcagcctcccgaatagctgggattacatgtgcccaccaccatgcccggctaatttttgtagttttagtagaaacgggctatcgctatgttggccaggcgggtctcaaactctttaagtggtccagtcctcctggcctctgaaagtgctgggattataaacgtgagccaccatgcctggccttgtttgcgctttttgttgttgttgagggagttgtttgagcttcttctatattatggatattagtcccctatgggataaatagttttcaaatattttctcctgtgcattgtctgtttacacacctggttatttcttttgctgtgcagaagctttttagtttaattgtcccatttgtctaattttggttttgttccctgtccttttaggtcttaagtcataaattctttgcctagaccaatgtccagaagaattttctcaaggtttttagtattttgatagttttgggtcttatatttaagtctttaatacatcttaagttgatttttgcatatggtgagagataaaggtctgtgtccagatttggttcctgccagtgggttggtggtctcgctgacttcaagaatgaagtcacagaccttcacggtgagtgttacagcttttaaaggtggcacggacccaaagagtgagcagcagcaagattcactgtgaaaagcgaaagaacacagcttccacacatggaaggtaacccaagcagattgccactgccagctgaggtggccagcttttattcccttatttgtccctgcccatgtttggtttttgtcctatcagagtgcccttttttcaatcctccctgtgattggctacttttagctactgctgattggtgcattttacagagcactgattggtgcattttacagagcgttgattggtgcattttataatcctcttgctagctacagagcactgattggtgcattttacgatcctcttttaagacagaaaagttctccaaatccccactcgacccaggaagtccagctggcttcacctctcaggttctgttttattttcctgcatatggctatctaatttcccagcaccgtttattgaaaaggatgtcctttcttcagtgtctcttcctgttagttttgtcaaagaccagttggctgtaactatgtcgtgttatttctgggttctgtattttgttttattgatctatgtgtctgtttttacagaagtattacactgttttggttaccatagccttgtaacataatttcatatcaggtaacgtgatgcctccagttttgttctttttgcttagaattgattttgctatttgggctcttttttctggttccataaggatttaacattgttttttctaattctgtgaaaaatgacattggtattttgatagggattgcatttcatctatagattgctttgggcattatggtcttttttttttttttttgagatggagtcttgctctgttgcccaggcgtgatctcagctcactgcaagctccgtctctcaggttcatgccattctcctgcctcagcctcccaagtagctgggactacaggtgcccgccaccacacctggctaatttttttttttttttgtatttttagagacggggtttcactgtgttagccaggatggtcttgatctcctgacctcatgatctgcctgcctcagcctcccaaagtgggtcattttaacaatattaatttttctgatccataagcatggaatatttttccattcgtttgtctcactgacagtttctttcatcagtgttttatagttttccttgtagagatgtttcacctccttgcttaaatgtattcctaggtagtttattttttgtagctcttgtaaataagatttccttctcagctagtttgttattggtgtatagaaatgctactgatttttgtatattacttttgtatcaattttactaaataaacttactaaattcatttatcaaatccaagagtgttttggtggagtctctaggtttttctagacaggtaatcctatcatcagcaaatggaaataatttgattttctcttttcctatttgaatgtcttttaattctttctcttacctgattgctgtggctaggacttctaatactatatcaaataggagtggtgaaagtgggaatacttgttttgttccagttcttgagaaaatgctttcaacctttcccccattcagtatgatgttggttgtgggtttgtcatataagccttttattatttgaggtatgttacttccatgtcaagttatttgagggttttttttttatcatgaagggatgctgaattttatcaaatgatttttctgcatctattgaggtttttaatccttcattctattttcgtgatgtatcacatttattaatttgcatatgttgaactatccttccattccttatgtacaacccacttgatcattgtgtattacctttttgatgtgctcttgaattccatttgctagtattttgttgaggatttttgtgtctatgtttatcagagatattggcatgtagttttctttttttgttttgttttgtctttgtctggttttagtatcagagtgatactggccttgttacatgaggaatgaagaagtccctcctcccagattatttggaacagtttcaggaagattggtattagttctttgtacattttatggaattcagctatgaatccatcaggtcctggactttttttttccatgggaaatttatttattactgattcaatcctgctactcattattggtctattctggttttcagtttcttccttcttcaatcttaggaggttgtatgtttccaggaatttagccatttcctggggatttttttggtttgtgagcatgtagttgttcataatagtcacagatgaaattttgtttttctgtggtatcacttgtaagtcttcttttcatttctgattttgtctcttctcttttcttggttgctagcagtttatcaattttgtttctcttttcaaagaaccaactttttgtttcattgctcctttgaatggtattcttacatagatgcaatgataatatgtcctataggctttagaagaatcttagtgcattgtcaaagaaacatttttagttgagcacatacattatgagcaaaggagtggcattagatcttcatagtagaaacagttatagtgtttctaatacatgtgtttcttagagagaatctaacaacattgaaagggcctactcacaaaggccactgtgcaaagataacaggaaactccccaaaagcttatcttcaagttagctgcatcaagtcctgtggtgcttgaaaatctctccattaatgctgaattgaagactacagggagatgaaaagactgtaggattaatatgcttcatcacgataatctataatattaagaaataatttaaaattgttgaacaaatatgtcatggtgtatgtcccaaaggttcattatgggctattgaattaataactttataaatctattcacatatcacctaagacataaaattattttgaaaagaaacagtggaatttgatatacaaacattttagaactcgaattgccttgtaaagatgtccacatatgattgggaaagaaggcagaccttcccagagggagtgagtaaagcatcatcagcaaataataagttaaacaaagtgaataaaagcttattgttaggtatgtaatgtttgtgacaatattgtaggaaatattgtacataaaatgctgtatggagtataaactcagatgtaacaggatcatatttgaaaatagtaaatatgtttaatattcttcttcttagtaaatcatgttccctagccatcattttaccttattgcaataccaatccaaaaagaggagaataagaggccatgtagttccacatcagcccagaaaaggcgtcccctctttctggtcatgacagattatgagaatgaaaaggggatgaaggcagaaagttcaggaggtgagacacgtatctaaactcctctatcagagctaaagtcccagaagtcaagtcttcttagctacactgaggaacaagtgaagaagagatgatgactttaatttagcttcctacttgagtttttgaagggagatcacttagcagggtacttgtggtagcctgttcaacaaatgtttccggttcttttccctttcaggtacacagcataattgtaattcctgtccacttgaggtagggtggaactatgtaactaattctgcccaatgacttgtgagtggaagtggaagcatttgattaccagagtgagaccattcagagctcttcttttccctctggcacagagtttttcacatgtctttcaagacaacacatatattagctgagaatatgggtacaaattaacagaggaaatgatcaggaagtcaattgagtctgtagtcaagggcagaaatgctactcaatgccagcaatcaggtaggccttacaatcagagtttggagtgcctatagcatcagcagaaatgatgtggcactcatcagcaaagggcgatgtacttgtttctgggagtatggcctataccaactgaatggccagtgggacgtagcaaccacagactttggaagtggtgttaaagaaaacacctgtgattaagtatagattaactataccttagtgatgtcatctaaggactgaaggacctgaccagtggagaccaacacagatactcatatgtcccaagaaactctctccacccacccaatgccatgaatttacatgagccctcatatgcccaaattccaccttggaaaacattagcgagaggacatgaaaatctggaagacaacacttactggaaaagatctcatctaaaataggctattcaacccgttagagattaggccactgacttacatttgggtttttccaaatctaggcaaatacttctgtattagttttgactaaaaatggaattacaagcaggtagtcatttcctataacatctccaatactagaggttgttgacgatactgaaaagaaaaatgattaattcattttcatgacattttctaggctctaaagcagggatcttaaaaatcagagcagccaaatgcttctactctgtaggattaatctatggcaacatcttaatgagtcttttgcttatctggtgcctatcttcacacatgttgacacctatacatattgggtaaattatgatatgataaagctaaaagtgctgatcataggtaatgataaatatcatttgcacaaacagcttaattcactcagaattgacatacctgactccttagccatatttaccattgatgctgttatgtttgactgcagatatcagattcatttgacattcaaaatgtcatttaatacaactcagaggaaagggtgaaataaaaataaagggtctattggctctcatatttctagtaactattagaagaagtagtaaacagaagttcatatctcatggctacaagcagaatgtttccctgtacagtcatacaactttatcaatgctgtattccaaatgcttttttattagatttgagtcactgcacttaagatctgggaacactgaccagctccatctggctggcctttgtatctgtgaacaaagtagagaaatacagaagggttatagtttctttggggggggaagctgagaaaaaagggtcactattatgaagcttgagcctaaactttttggatatattaacattaaatacaacatgtatcagtaaacatttagattttataaattatatattttaataatttttattatgtatttatttgaaaaaatcagttttataccatattctattttgagatattgcattctaataaatagtggtgagttcatatggctaaaagtgtcataaagaaatgcttaggggtgaactttcctattgtaagtattttccttgtattttgtaatctgattttaagctatggttatcggttgtgcactaataatggtatttctcaaaggaagaaatagtataatataaaaagtatttcataaagtgctcaattaattttttttttttgttgttgttgttgtttgtttgtttgtttgttttttgagacggagtgtctctctgtcgcccaggctggagtgtagtggcgcgatctcggctcactgcaagctctgcctccagggttcacgccattctcctgcctcagcctctggagtagctgggactacaggcacccgccagcacacccggctaattttttgtatttttggtagagacggggttttaccatgttaaccaggatagtctcgatcttctgacctcgtgatccgcccgcctcggcctcccttgtgttgtttgtttgtttgtttgtttgtgacggagtctcgctctgtcggccaggctggagtgcagtggcgcgatctcggctcactgcaagccccacctcccgggttcacgccattctcctgcctcagcctcccaagtagctgggactacaggcgctgccaccacgcccggctaattttttgtatttttagtagagacagggtttcaccgtgttagccaggacggtctccatctcctgacctcatgatccgcctgtctccgcctctcaaagtgctagaattacagaccgtgcctggactctcctaggtttattggtatttgtcttttccctctgtcttcacatggtctttcctttgtgtgtgtctgtgtcctaatctcttcaatatgacaccactcatattagcttcatatccatctctatgacctcattttaccttgattacttctttaaacgttctttcttcagatatcacattatgaggtactgggggtcaggacttcaacctgtgaattttagagatacacagttcggcccacaacataaatgaacctcgaaaacattatgctaagtgaaataaatgagacataaaaggagagatattgtatgattacacttacatgagatacatgaatagtcaaattcagagacaaaaagtagaagaatggttaccaagtcctggggaaagggttggaggaatgcggagttattgtttaatgtgcagttttgggatgacacgaaagttctgaaggtggatagttatgataattgcacaataatgtgaatacacttaatgccactgaattgaatatttaaaaatcgtcaaaaagataaattttatgttatgcatattttaccacaataagaaagaaaactctagaaataaaaatatagtaacagaaatgaagaatgcctagcaatgcattggagagggaataaatggtatcaaaattaaatcttttatttttcttattcttaatatgtgtaaagcataacatttaaaaataatagtattacaatgtattgcatgattatcaaatatgaataagtgcgattaatgatagcagtattacaagggacatgagagagaagttgagaatattctgtatgaggtacctatactgtacacaaagtaatataatgacatctgaaagtggactgagagtacagaatcatatattgtaaactgtagagcaacaattaaaaaccttttaaagagaagtataattactattctaagaaaggaaataaaatggaatcatataaaatgatcaattaaaaagaagacagaaaaagagtaggaaataacaaacagcaaattcaatgagcagaaaacaatgacaaacatagtagatatcactccacctatatcaataatcacttcaattatgaatggtttaaaaatgctattgtaactgtactccatttgcttaagaaggtagatgaaaagctatatacattaaggagagacatggaagatacaaacactaaaataaaacttctaaaggtaaaaatacaatatctgatataaaaattcattggattagattaacagcagattaaacattgcaaaggaaaagattcatgaataaaaatcatagcaactgaaactatacaacatgtcacacacagatttaaaaaaagactgaaaatgatgaagagggaatctgtaagctagataaactgcaagcagcttaatatatgtaagattggagttcccaaaaagtagtaaagaggagaataataaaaatgagggccaggtgcagtggctcacacctgtaatcccagcactttgggaggctgaggtgggcggatcatttgaggtcaggagttcaagaccagcctggccaacatggtgaaaccctgtctctaataaaaatacagaaattagctgggcgtagtagtgggggcctgtaataccagctacttgggaggctgaggcataagaattgcttgaacctgtgaggtggagattatagtgagctgagattgtgctaattcaactctagcctgggcaatacagcgagactcagtctcaaaaaacaaacaaaaaaaaacaacaacgaatatttgagtacacaatggctgaatatttacaaatttcatggtaactacaaattcacaattccaaaaatctcaataaactcaaacatgaaaaaattacaaggcacattaaagtcagattgtttaagactactgatggacagcgttaaatgcatccagatgtggagcacatgagatacaaactaacaaagaatgagaaaagaatgaaagcatattcctcattgaaagaaatgcaatcaagaaaacaagtatagcttttctaaaatacggaaataaaataaaagtactgaaatagttctatagtatttgtactcagggaaatcagattttcacaaatgaaggcaaaataaagagcttttcagacatgcaaaagctaaaagaaatcagtagcagaaccatatcacaaagaaatgctaatggaaattcttcaggcggaaggaaatgacacccagtgaaatctacctctattcaaaggaatgaaaagcatcagaaattatagctacatgagcaaatatttgtttcttattatgtaaatttcttttttattattactattatttttaaattatagtttcagttctggggtacatgtgcacaacatgcaggtttcttaacatatgtatacatgtgccatgttggtgtgctgcacccattaacttgtcatttacattaggtatatctcctaatgctctccctcccctctccccccaccccacaacaggccccagtgtgtgatgggggcctgtgtccaagtgttctcattgttcaactcccacctatgagtgagaacatgcggtgcttggttttctgtccttgcgatagtttgctcagaatgatggtttccagcttcatccatgtccctacaaaggacatgaactgatccttttttatggctgcatagaattccatggtgtgtatgtgccacattttcttaatccagtctatcatttttggacatttcggttggttccaagtctttgctattgtgaatagtgccacaataaacatacgtgtgcatgtgtcttcataccagcatgatttataatcctttgggtatatacctagtaatgggatggctgggtcaaatggtatttccagttctagatccttgaggaatcgccacactgtcttccacaatggttgaactagtttacagtcccaccaacagtgtaaaagtgttcctatttctccacatcctctccagcacctgttgtgtcctgactttttaatgattgccattctaactggtgtgagatggtgtctcattgtggttttgatttgcatttctctgatggccagtgatggtgagcattttttcatgtgtctgttggctgcataaaagtcttatttgagaagtgtctgttcatatcctttgcccactttttgatgagattgtttgattctttcttgtaaatttaagttctttgtagattctggatattagccctttgtcagatgagtagattgtaaaaattttctcccattctgtaggttgcctgttcactctgatggtagtttcttttgctgtgcagaagctctttagtttaattagatcccatttgtcaattttggcttttgttgccattgcttttggtattttagtcatgaagtccttgcccatgtctatggcctgaatggtattgcctaggttttcctctagggtttttatggttttaggcctaacatttaagtctttaatccatcttgaattaatttttgtataaggtgtaaggaagggatctactttcagctttctacatatggctagccagttttcccagtaccatttattaaatagggaatcctttccccatttcttgtttttgtcagatttgtcaaagatcagattgctgcagatgtgtggtattatttctgagggctctgctctgttccattggtctccatctctgttttggtaccagtaccatgctgttttggttactgttgccttgtagtatagtttgaagtcaggtggtgtgatgcctccagctttgttctttgggcttaggattgtcttggcaatgcaggctcttttttggttccatatgaactttaaagtagttttttccaattctgtgaagaaagtcattggtagctcgatggggaaggcattgaatctataaattaccttgggcactatggccattttcacgatattgattattcctacccatgagcatggaatgttcttccatttgtttgtgtcctcttttattttgttgaacagtggtttgtagttctccttgaagaggtccttcacatcccttgtaagttggattcctaggtattctattctctttgaagcaattgtgaatgggagttcactcatgatttggctctctgtttgtctgttattggtgtataggaatgcttgtgatttttggacattgattttgtatcctgagactttgctgaagttgcttatcagcttaaggagatttggggctgagatgatggggtattctaaatatacaatcatgtcatctgcagacagggaaaattggacttcctcttttcctaattgaataccctttatttctttctcctgcctgattgccctggccagaacttccaacactatgttgaataggagtggtgagagagggcatccctgtcttgtgccagtttttgcccattcagtatgatattggctgtgtgtttgtcataaatagctcttattattttgagatacatcccatcaatcctagtttattgagagtttttagcatgaagggctgttgaattttgtcgaaggccttttctgcatctattgagataatcatgtggtttttgtctttggttctgtttatatgatgaattaaatttattgatttgtatatgttgaaccagccttgcatcccagggttgaagcccacttgatcatggtggataagctttttgatgtgctgctggatttggtttgccagtattttattgaggatttttgcaatgatgttcatcagggatattggtctaaaattctctttttttgttacgtctctgcgaggctttggtgtcaggatgatgctggcctcataaaatgagttagggaggattccctctttttctattgattagaatagtttctgaaggaatggtaccagctcctctttgtacctctggtagaatttggctgtgaatccatctggtcctggactttttttggttggtaggctattaattattgcctcaattttagagcctgttattggtctattcagggatccaacttcttcctggttcagtcttgggagggtgtatgtgtccaggaatttatccatttcttctagattttctagtttatttgcatagaggtgtttatagtattctctgatggtagtttgtatttctgtgggatcagtggtgatatcccctttatcattttttattgcatctattggattcttctctcttttcttctttattagtcttgctagcggtctattttgttaatcttttcaaaaaaccagctcttggattctttgattttttgaagggttttttgtgtgtctatttccttcagttctgctctgatcttagttatttcttgccttctgctagcttttgaatgtgtttcttgttgcttttctagttttttttaattgtggtgttagggtatcaattttagatctttactgctttctcttgtgggcacttaatgctataaatttccctctccacactgctttaaatgtgtcccagagattctggtatgttgtatctttgttctcactggtttcaaggaacatctttatttctgccttcattttgttatgtacccagtagtcattcaggagcaggttgttcagtttccatgtagttgagcagttttgactgagtttcttaatcctgagttctagtttgattgcactatggtctgaaagacagtttgttataacttctgttcttttacatttgctgaggagtgcttcacttccaagtatgtggtcaattttgtaataagtgtgatgtggtgctgagaagaatgtatattctattgatttggggtggagagttctgtagatgtctattatgtctgcttggtgcagagctgagttcaattcctggatatctttattaactttcagtctcgttgacagaaagtttctgtcaattcctggatatccttgttaactttctgtctcgttgacagtgggttgttaaagtgtcccattattattgtgtgggagtctaagtctctttctaggtctctaaggacttgctttatgaatctgggtgctcctgtattgggtgcatatatatttaggttaattagctcttcttgttgaattgatccctttacattatgtaatggccttctctgtctcttttgatctttgttgatttaaaatctgttttttcagcgactaggattgcaacccctgcttttttttgttttccatttgcttggtagatcttcctccatccctttattttgagcctatgtgtatctctgcacatgagatgggtctcctgaatacagcacactaatgggtcttgactctttatccaatttgcccctctgtgtcttttaattggagcatttagcccatttacatttaaggttaatattgttatgtgtgaatttgatcatgtcattatgatgttagctggttattttgctcattagttgatgcagtttcttcctagcctcgatggtctttacaatttggcatgtttttgcagtggctgatactggttgttcctttccatgtttagtgcttccttcaggagctcttgtaaggcaaacctggtggtgtcaaaatctctcagcatttgtttgtctgtaaaggattttatttctccttcagttatgaagcttagtttggctggacatgaaattctgggttgaaaattcttttctttaagaatgttgaatattggcccccattctcttctgccttgtagagtttctgctgggagatctgctgttagtctgatgggcttccctttttgcataacccgacctttctctctggctgcccttcacattttttccttcatttcaactttggtgaatctgacaattacatgtcttggagttgctcttctcgaggagtatctttgtggcattctctgtatttcctgaatttgcatattggcctgccttgctagattggggaagttctcctggataatatcctgcagagtgttttccaacttggttccattctccccgtcactttcaggtacaccaatcagatgtagatttggtcttttcacatagtcccatattatttggaggctttgttcatttgtttttacttttttctctaaacttctcttctcacttcatttcattcatttgatcttcaatcactgataccctttctttcacttgattgagtcagctactgaagcttgtgcatgcatcacatagttctcatgtcatggttttcagctccatctggtcattgaaggtcttctctatgctgtttattcaagttagccattcatctcatcttttttcaaggtttttagcttctttgatatgggtttgaatatcctcctttagcttggagaagtttgttattactgatcgattgcagaatggcaaatgttgctgcctgatccttcctctggaagcttcatctcagaggggtactaggctgtatgaggtgtcagtcggcccctactgggaggtgtctcccagttaggctactcgggggtcagggacccacttgaggaggcagtctgtccattctcagatctccagctccatactgggagaaccactactctcttgaaagctgtcagacggggacatttaagtctgcagaagtttctgctgccttttgttcagctatgctctgcccctagaggtgcagtctacagaggcaggcaggcctccttgatctgcagtgggctccacccagttcgagcttcctggccactttgtttacgtactcaagcctcagcaatggcagacacccctcccccagccttgctgccaccttgcagtttgatctcagactgctgtgctagcagcgagcaaggctccatgggcgtaggaccctccaagccaggcacaggatataatctcctgctgtgccatttgctaaggccattggaaaagcacagtattagggttggagtgtcctgattttccaggtactgtcagggctacccttgactaggaaagggaattccccagccccttcttcttcccaggtgaggcaatgccccgccctgctttggctcatgctccatgggctgcacccactgtccaacaagccccattgagatgaacctggtacctcagatggaaatgcagaaatcactcatcttctgtgtcactcacgctgggagctgtagactggagctcttcctatttggccatcttggaacctcccctcatgtaaatttcttttaaagataattgattaaacagaatgataacaatgtgttgttattgcaacatatgtatatacaaataaagtatatgacaacaaagcataaagactgagaggggagaaatgcaagtatactgttgtaaggtttgaatagtatatgtgaaatggtataattcacttgaagctagattgtgataagtttaagatatatactactactccacagcaaacacaaaattagcaaaataaagaattataattttaagccaaaaaataccagagacaagtctcaatcaattcagaagtttatttagccaaggttaaggacatacccgtgacatagccttaggaggtcctgagaacatttgcccaaggtgatctggctacagcttgaatttccatgttttagggaggtataagacatgaatcagtacatgtaagacatacactggttaggtctggaaaggtggggtgtattagggttctctagagggacaggactaataggataaatgtatatgtgaaagggagtttattaaggagtatacactgtcacaaggtgaagtcccaaaataggccatctgcaagctgaggagcaaggaagccagtctgaattcccaaatctcaaaaatagggaagccgacagtgcagccttcagtctgtggctgaaggcccaagagcccctgccaaaccactggtgtaagtccaaaagtccaaaagccaaagaacttggagtccaatgttcaaagccaggaagcatacagcatgggagaaaatgaaggccagaacactcagccagtctagtccttccacattctcctgcctgctttattttagctgtgctggcagctgattagatggtgcccacccagattgagggtgggtctgcctcttctagtccactgattcaaatgtcagtcttctttggcaacaccctcacacatacacccaggaacaacactttgcacccttcattccaatcaagttgacactcaatattaaccatcacatggagtaatgtgaagggggaggaaggggcagtgggggggttgtggactgcaagtcataagtggattaaaagatttcctgattggcaatgggttgaaagcttttatctaaagacctggaattaatagaagggttaaaataaggggctgtggagaccaaggtttttattatgcagataaagcctccaggtagcaggcttcagaaagaatagattgtaaatgttttttatcagacttaaaaaggtaccaaactcagttaattctctcccggatcaggaagaagacctggaaataaaaggagattttctatagaaggtagattttcccacaagagacagctttgcagggccatttcaaaatatgtttaagaaatatagccaggcacgttggctcatgcctataatcctagcactttgggaggctgaagcaggcagatcacttgaggtcaggagtttgagaccaacctggccaacatggcaaaaccacgtctctacaaaaaatacaaaaaaataagccaggaatggtggcgggcacctgtaatcccagctattcaagaggctgaggcaggagaatcacttgaacctgggagacggaggttgtggtgactgagccaagatcatgccactgcactccagcctgggcaacagagggagactccatctcaaaaaaaaaaaaaaaaaaaaaaaaaaagaagaagagggagagaaaagaaatatcttttgaggtaaaatatttttatttcttttagggcttgctgtctgtcatgttggtatcttaatggctaccaagagtctgtttcatcagtcgtaaggtctctgttttaatgttaaatgctggtcagctgtgcctgaattccaaaggaaggtgagtatagtgtggcgtgtctgacctctactacccatcatggcctgaactgattttccaggttaacttaggaatgcccttgtttgagaggaggggtccattcaattggttgatgggcttagaattttacttttgatttacatagttaatgaaccagaaaggaagatgaaatgtaataaaaatgtttgatccaaatggaaaaaaagaagaaaaaagaacaaaaatcaaaattatcgactcaaacctaactatataaataatcatattaaatgtaaatggtttaaacacctcaattaaaagtcaggaattgtcatataatttttttaggaagacccaattctatgctgcttacaagaaatacactttatatataaagaaacaaagaggttaaaaaatacataccatgttaacagaaatcaacagaaagctgataaatctagccagactaatcaggcattagaagaaaaaaatgccagtagcaggaatgagaaaggtgacatgattttaggttttacagatgttaaaagaatcataataaaatattatatataacttcatgtcaatgatttccacaattgtcataaaatagatgaactccttgaaatacacaaactaccatatctcactcaagaagaaatacataatctgaatagccctacatctgttagagaaatacaatttgtagttacaaaaccttcacataaagaaaatgccaggcccaagtggtttcactagtgaattatatcaaatatttaagaagtaatactaattttacatgaactcttcatagaaaatttttgagaaggtaattatttcctacctcattctatgaaattagcattaccctgatataaatgtcaaagacattacaagaaaagtaaactagagacaatatctctcatgacattagttgaaaaaatgcaattttagcaattaaattacagcattatgtaaacagaataacacacaaggaccaagggggcttatcctaagaatgtgaaattgtttgaacatttaaaaatcaaacagtgtactaagaagaaggaagacaaaaacagaaatgaaaaagacattgcaactgatgtcacagaaatccaaagatcataagaaactgctgtgagaaaaaatacaccaataaactcgataacctagaataaatggataaattcctagaaacatacaacctaccaagagtgcatcatgaaagaaataggaaatttaaacaggcaaacagtaaataaggagatcgaatcagtaataaaaaaaactcccaacaaagcaaagcctccgacctgatgactctgctgctgaagtctaccaaatatttaaagaagaattaataccaatcattttaaaactcttcccaaaaaatcaaaaaggagggaatatttccaaactcatttcacgaggccagcattatgtgaatttaaagacagacaaagacactacaaaaagaaaactacaggtcgatgtccctgattaatatagatgcaaggatcctcaacaaaataattgcaaaccaaatttaacagcaaattaataggatcatacaccaagtgggatttatccctgagttgcagggatggttcaacatgtgaaaatcaattaatgtgatacagttaatagaataaaagataaaaatcacaaaatcatctcaatagatttaaaaataataatttgataaaattcgacactttttcatgttagaaactctcaacaaactaggaagagatggaagttacctcaacatattgaggccagatatgaaaatcccacagctaacaccacactcagagtaaaaaactaaaagcttttcctctaatatcaggaaaaagacagggatgttcacttttaccacttctattcaacatagtaatgaaagtcctgcccagaatgattattcaagatcaatacaaaaaatacatcaagttcagaaggaagaagtgaaattgtacctgtttaaacatgatctaatatacagaaaactctaaagactccacaaaaaactgttagaattaataagtcaattcagcaaagtagtatgataaaaaacaatatgtaaaaatcaattgcatttctatacaccaaaaataaactctctgaaagaaaattaggaaaccaatcccatttacaacattatcaaaaataatcaaatacttaggaataaacttagccaaggaggtaaaagacacactgcaaactgcaaaacattaatttaagaaatttaaaaggacacaagtaaatggaaagacatactgtgttcatagattggaagtcttaatatctacactactcaaagcaatctacaaattcaattcaatatccataaaaatcctaatagcatttttacagacagagaaaaaacaattctaagattcatatataattggaaagtaccctgaatagccaaaacaatcttgagaagaaagagcaaggctagaggcatcacttcctaatttcaaaatatattgcaaagctatagtaattaaaataatatgttaacagcataaagatagacatttaagaccaatgggttagaatagggagccaagaaatagatctgtgtatatacagtcaattgatctttgacatgggtgccaagaatgcacaatcaggaaaggacagtctcttcaacaaatgctgctgggaaaactggatatctccatgcaagagtagaactggatccttgtcttataccataaacaaaaattaaatcaaaatggattaaaaacttaaatgcaaggtgagactgtaaagcttctataacaaaacactgggaaaaagattaatttccaaaatacgttaggaactcaaacaactcagtagataaaactaacaatctgattttttaaatgagcaaaggacttgaatagacatttttccaaagaagagaaatacccacaggtatatgaaaagatgctcagtgttactaatcatcagaaaaatgtaaatcaaaaccacaatgaaatatttcctcacacctgtcaggatgattattattaaaaaaaaaaaaagacaagtgttggaagggatgtggagaaatggaacctgtgtacattgtttgtgggaatacacgatggtgcatttactatgggaaaaaagtacgaacggtcttcaaaaagttaaaaacagagccattatattgctccaataatcccacttctgagtatttatccaaaagaattgaaatcaggatcttgaagtaatattaccattcctatgttcattgcaacactattcgtaatagctcagatgtagaaacaacattaatgtccattaacagataaattcataaagcaaatgtggtatagacatacaatggaaataatattcagcattaaaaaagaaattctgcaatatgcacaacatgaataaaccttgaggatattattccaagtgaaataagccaatcacagaaagacaaatcccgtataatttgcttattttagatagtgaaaatattaacagtacaattcatagaatcaaagagtggaatggtggttgccaggatgggagtgaaagggaagtgaggagttgcttatcaatgggtataaaatttcattaatgcaagatgaattagctttagagatctgctgtgtaatactgtgcctatagttaacaatattttattgtatactgaaaaatctcataagagagtagatctcatgttatattcttaccacaataaaataaaaattttaaaaatcaagcactgtagttcaccaaatagagaaattaaaaaagaaaagatcttatctcagtataatcagaagaaaataactctcagcaaactggcactagcaggaaacttcttcaacctgattaaggtaatttacaaaaaacctacaggtaatgtcacgcttagtgagttttctcacattttttcaacatttccagaaagatggttgactttgctgggttttctttccttttcttaacctataagaacaatctctgtaacctgcatcctttgcccacgaatgaactctgacttcctgaaactctaagtgagcaacttggttgttacttctggaggtatcagccttctgctaattgcatttaagatgccattgtagaaagttttggccacaggacctggctggaaaacactggccccactggactgtactctgtactcaaactttccttaagtataaagatttgatagagaatggcttttacataggaagatcctggggatggttaagcacatgagaaatgattattggggttctctgagaaagaaaattgtcagaagaggcaattgaatcaccgagatctacgaactaatgtagaataagtcactgcaagcatcagcttagtttctctccaaatgagaaagcagtcgtcaaactccttcacatatccttgaaacatacgaacaatctgggcatctgttgtctacacaggggttgcttctcttgaattctctaaacataatttggtacaatagagtattagtcttttgcatttgtgtgtgtgtgtgtgtgtctgtgtgtatacacacacagacatacacacatatgccatacaatattttttgaagttttattaagtttaataattgaatgactaatactgcagctatgtctagcatattgtgttagaaaacatgcttagcctctctgtaagagagagccccagagaactgggaacgtttatctatgtagaaccatatatctagtagaaccatagaacatttatctatgtaggctgaatgtgcgatttatcatattctcaacaataatcctatgcttggtgaaatgtataagggacctttgcgtacctttttttctttttgcaacttcatgtgaatctacaattatttcaaaataaaaaaatttaaaaagtacatgtgtcaaaagaaatctcttgataaacataaaacaataaaaaaggaacctttgtcagaaacacatggataggctctctgtgattgtctctcatggctgttgcttaacttgaataaaaattcacatcatgtcaaatattacaagcaacattatctgtgacatagtctattgaagcagtcacattggcattggggagatacacaaacaaagcaaaccatagccatctggtattctcagcttgtttacaaaatcacttaacaaggctaagttgaagatgtggaaatagaggttcatctgggagtgaatggtctcacctgtccccgacttacttttctctctctccatttccctcagggctcaatgaagagggagtcatgaagaatttggatgagcaagtgccccagtcctatgtatttatgtctccccactgatgtacagtgctccatctgccataaatatctatcgactcaattctgagtcatttactggacttctattttttttcctttgggctatttcatctatcaggagatttgccccatgctgtcttgaaggctaacattatgaattttgattggtggtacggcagttccttacatcttattattattatttttattctacagatttgttttcaattcttcggcctttgactttttttgtacgaaggtaagaattattaatagttgtttaaatactcaaaaaacacagtgaaaatttttaggggaaatgcactgaatatatctatcaatttgaaaatggaggctgggtgcagtggctcacgcctgtaatcccagcactttgggaggcaaaggcaggcagatcacgaggtcaggagattcagaccatcctggctaatatggtgaaaccccgtctctactaaaaataaaaaaaattagccgggcgcggtggcgggcgcctgtagtcccagctactggggaggctgaggcaggagaatggcgtgaacccgggaggcggagcttgcagtgagccgagatcgtgccacagcactccagcctgggcgacagagtgagactccgtcttaaaaaaaaagaaaagaaaatggaaaagcttaaaatcatgagttatatagtattatcttacatattactatatacataattcagtgaattatagtattcaagaatatagaatgaattttcatttagttttataaatttccatgtttcttgatcttattgagcattcaaggcaatcaataaaatatactcctgatactagaaattccttatattttctggatattttttgtggcatctgtacattgcaaatactttctaccagtctgaagattggttgtcactttgttaggttttctttaagatgttttttctttctggccgggcgcggtggctcacgcctgtaatcccagcattttggaaggccaaggcgggcggatcactaggtcaggagatcgagaccatcctggctaacacggtgaaaccccctctctactaaaaatacaaaaaattagccgggcgtggtggcaggtacctgtagtaccagctactcaagaggctgaggcaggagaatggcgtgaacccggggtctgagcttgcagtgaacctagattgcgccactgcagtccagcctgggtgacagagcgagactctattcaaaaaaaaaaaaaagagatttttttcttttcaatgtggaagagttaaattatcttttcctattgtggttttgtttcagacagtattcataagaaaattctcttattctttttactaaatgactcacatattttgtttcaaatttaagtttttaatcccactgggatgaatttagtgtaaggcgtaagtacggatccacaatgtttccatatggatatctgaatggtttaactgcttttattttattttatttatttatttatttatttattttgagatggagtctcgctctgtcacccaggctggagtgcaatggtgtgatcttggctcactgcaacctccgcctcccgggttcaagcgattctcctgcctctgcctcccaagtagctgggattacaggcgcccaccaccacgccaggctacttttttgtatttttagtagagagggggtttcaccatgttggtcaggctggtcttgaattcctgacctcaagtgatccgcccgagtgatctgcccgcctccgcctctcaaagtgctgggattacaggcgtgagccacagcgcccggccttgactgcttttaaaatagtcatctttctaaattgccctgctgtttccactttctcgtaggtatctgtttccattttgtttcttcagtttcattggcttgtctctattttttccaatacaaagctatcttaattaatttattttcatcataaattgtaaggtccagtagataatttctcttatgttattactgcatgagagtgtctttggttttctttggtgtgaggtttattttttcatattaattttgcgtcagcttatgaaggacattaggaaatctggttgaggttttggctggaattaacattgacaatttgggtggaattgatattttttatgattttgacttttcctattgatatttgcagtataaatctccatttatttgcttttattttttttctcttatgaataagttcacctttaaaatggtgaaaccatagtattcatctctcagggtaggttaaatttcttacaatagtgaggggactataaaatactttttatctttggtgaaatttacccctaagttcatagcatttgagtttgctattgaaaaatttgttatttatatttttaaattaacaattacacatttttttaaaaccagttaatcaccaagtatgctaatcctaaattacattttctctcctcactgatgtgtgtgtcccctctgtaagacaccatgtggatataaatgctaagtatgattctgggcctctggtcttttcctgtgagctactttgtctctcactgtgcctataccactgtcttgatgagtctggctttctaaaaccttgattggtagtaaggcacgtgctccaaatgtatttgtttcttttacagatatttttgagttttcttacctctctttttttcaaatatatatgaaaatctggttatcgatgtcctcactcaacctagtggatattttaagtggaaaaatattgtatatagatagcatattgaactgtgagatgcttcatgtatggaactatcttatgcatgaacatagacctgattaagttatgtgcattgacaggttggaaagatgcatttaagatttaagaacaatcaatgacttcctctgtttccactagagtccccacaaaattgaaacacattaggggaaaaacgtagatgaagtccaaaatatttttaaaaatagctcacagataatgactcataggacaaaacattcagggttggagctcagccagctttaagttctcagagcttaaagggtcagggtcactagctcaaacctgaggcccctaatcagcctggcacctgtcctaaggttggaatgggctgatactttgcactggacactcttgttccctgagagatgcccactttgctctacttgcctcatttgttctaataagatcctatactggtgatgtcagcaggtgtctgatacaaggaaatatgttgtatggagtgggagaggtgaagagtagtgaggtagtgatttcatggtgtgggatacattaggaccaacccacttagaaaaaaatgaccttagcaacaattttttaccactaatgcccttggcaaaaacatccttaagaacaattgcccttggcaccaacacttttaaaaatatgcctatcacaacaatgactcttattaataatggcccttagcaacaaatcccatagcaacaatacccttagcatagacaccatcaggaataatgctttaagacaacattgttaatattaacccttttagccaaaagactcttggcaacataatctaagcaacagtaacattagaaaaatgccctcagctataacactatttgccacagttgttcttagcaacacctttgactgacatcaacactcctagaagcaatatcttacattagcaatcatagaccttaacaaccaccccaaacaacaatgaccttagcaacaaatagcttgacatgaatacctttaccaaaatgtcgtttaaaaaaatggcctttagcatcaagacccttaacaaaaatggcccttaggaaaaatgaccctagagacaacactcataacataacaacaatggtccctaacaacaatgtccttagcagcaacatcattagcaatggtgcaccttactgacaaatctctaagcaacaacaaccttagcataattgcctgtagaaatagtgggaattatgccaattgcaacaatgccattggcaacaatgtctttaaaatcaatgtccatagcaacaatgcccttaggaacaatggtatgtccatttacctctataaattgccatggtactttggaaatggtcaaaccatggcctgttagtgtatcttagcaaaaacacccttagaaataataccttcaaaaaccatggcccttagcaataacaaaattagaaataaagcaattagcaacaatgcccttacaaaaatgtcctttatagtggcattaacaacagcactcttaccaatggcaccttagtaaaaatgcttttagtatcaactccttagcaataatgacatcagcaacagtgttgttggcaacagcacactttacagcaatgtcctagctacaaaatacataatatcaatgaacttagcaagaatggctcttggagacaatgctccgaatggtaatactcatagaatcaacactcttaacatcagtaccattagcaagaaaggggtaaacaaccgaccttagaaatgacattcttaataatgtccttagtaaaaaaatcatgagcatcacccctataaccagtgcccttagcaacagtgctcttatccaaacttgccttaccaagagtttaccattgtttaccttataaacaatggcccttagcaaccacactctttgcaacaatgtcctaacaatattactattagcaaaaatcccctaagaccagcattcttgacaacagccctcttggcccttagaagcaatgactttagcaaccaacgttgagccataaaaataaagccttggtaataatgctcttagcattgaccttagtaaaatggtcttagcaacagtctttagcaagagtgactctagaaatgtccccttcccaacaatgccctttgaagaaaatacctgtaacaacaatgcctttagtcacaatgccttcagcaaaaatgtcccttgccaacattaacaccctaggaacaatgatctgagaaacagtgtccttaacaataatatacaaaaacattctaagcaatagtaccctaagcaacaatatacttagcagtaataccctcagtaacaatactcttagcaacacgagatttaggatcagtgctggtagaaacagcatcatgagaaacactagcaatagtaataatgcctttagccacaatgaccttcaacagttctcttatgaacatcacccataactacaatggctccaggaacaatgcacttagaaataacttccttagcaacagtgaccttactatcgatgccaattgaaatatcatccttaggcacgtgttccatggaagcaacatcattagtaaccacagcttttgtaacaatgacttttagcaaaaacattagcatagtgccttaacaaaggcccttagaaacaatgcaactacaggccgggcaaggtggctcatgcctgtaatcccaagcacattgggaggctgaggtgggtggatcacttgaggtcaggagtttgagaccagcctggccaacatgatgaaaccccatctctaccaaaaatacaagaattagctgggcatggtagtgcacgcctgtaatcccagctactcgggaggctgaggcaggagaatcacttgaacccgggaggcggaggttgcagtgagctgagatcatgccaccacactccagcctgggcaacagagggagaatccatctaaaaaaaaaaaaataaaaaaaataagaaaagaaaagaaaaaagaaacaatgcaattatcatcaattcccttagcaacggatcctttagaatataatgctcttaacaacagcactcttagcaacaacatccttgacaacagtgtacttagcaacagtgcctttagctaaaatggcctttagtaaaatcaactttagcaacaatgcccttataaaagatgccccttgtaacagtgtccttagccagaatctctttaggaacaatgcctttaccaaaatgcatttaagttcaacggccttagcaacactgtccttggcaatattagatcttagtggcaatgctctcagcagcagtggtactcagcaatgatttctcttacaacacccttaacaacaatacccataacagcagcacactttaaaaaacaggcttagcaacaatgtccttaacatcaatgccttttggaacatcaaccttagcgacaactgcacttactaagagtgcctttagcatcagtccccttagcaataccaccattcaaaccaataccccttagccaaaatgattctaataacggcacactttattttctttttgacagagtttccttcttgttgcccaggctggagtgcaatggcatgatctcggctcactgtaacctccgcctcccaggtttaagccattctcctgcctcagcctcccaagaagctgggattacaggtgtgcaccactaagcccagctgattttgtaattttagtagagatggggtttcaccatgttggttggtcaggctggtctcaaactcctgacctcaagtgatccaccggcctcggccttccaaagtgctgggattacaggcgtgagccagcgtgcccggccaacagcacactttcaaacaacaccttaacatcaacatccttaactctctttgcaacaatacccttaggattaagtccctgagcaatagagtcattaacagcagtgtatttagtagcaatgcttctttactgtaatacacttaacaataatgaacatagtaacaatgcccttagccataaaggactttacaacaacaaccttagcaacgacactcacagtgacagtgtccttcaaatgagtttcttagaaacagtggtcttaggatcaacattttagcatgaatgctctttgcaacaattattctaggaaaagtgcttctagcaactagccctttagcaacaacacactgaacaagaatgctctagcaaaaatgtacttaataacaacatccttagcaaaaatacccttagcaaaaatgagtcttagtaacagagccttaatgtcaatgtccttagctacaatgcccctaatatcattgtcagagtgacaatatccttagcaacaataggccacatcaacaaaacacctagcagcaagttcctcagtgacaatgtgcttaatataaatatccttactcacaatgtcctttagcaactcttataggcaatggccttaacaataatattcataataatattttccttacaacagtacttaacaacctttgcacagcacccttggaaaaaagccaatttagcaaaacctttcttggctaccaaccatagcaacaatgccctaagcaataacacctttagtatcatttcccatagaaacagtggctataaaacaaggccatcagcaacagcatgcttagcaaaaatatctttagaaacaatactcttggcatcaacaccttaaaaacaacctcattattataactgcctttaataaaaatgccatgaacaaccaggcccttagcattggtgcagtatcaacagtgaccttagaaacagcaccattaacaacaactctgtgagcagcactatttgcaacaatgtccttattaacaatgcatttagctagagtacccttagcaattggctcttagcaacatcacatttggaaacagtactcatagcagcagctcccttatcaacatcactcatagcaaaatctgttttattttcaacactcttactatcaaggcctttaagaacaatgactctaagaaaatagcccataacaacaatttccttaaattcaacactctttccttaggaacagcacctttagcaccaatgatcttagcaacagtagcctctgcaatagtggccatggccacaatgttcttagtaacagcacctttagcaaaaacatccaacaacaacattaacatcaatgcctttggctgggcacagtggctcatgcctataattccagcactttgagaggtgggatcgggaggattgctttagaccaagggttcaagaccaggttgggcaatgtagtgagatctcatctctacaaaaagaaaaattaaaaaaattaaaaagctagctacatgatatggtttggctgtatccccatccaaatctcatcttgcattgtagctcccataattcccacgtgttatgggagggacccgatggaaggtaattgaatcatgggggtgggtctttcccatgctgttctcataatagtgaataagtctcatgaaatttgatggttttataaaagggagtttccctgcacaagctctcttgcctgctgccatgtaagatgtgactttgctcctcttttgccttctgccatgattgtgaggcctctccagccatgggaactgtgagtcaattaaatgtctttcctttaaaaattacccagtcttgggtatgtctgtattagcaacatgagaacagtctaatacactaggcatggtggtgtgtgcttgttgtcccagttgctttggagactgaggcaggaggatcactttgagcacaggagttcaagcctgcagtgagctgtgatcatgcaactgcactccagcttgggtgacagagtgagaccctgtctcaaaacaaaacaaaacaaaacaaaaatgcctttaagaacagcatgtttaacaaaagaacctcagcaatgacttccttagccacaacaaccttggcaaaaatattattactaccattctcttagcaattaagtccttaggaataatgctctgagaaaaaaagtgcttttagcaacagtttccttagaaacactagtcatagcaataacacccttagcaaaactttctttgcacaataacttcaaggccttaaagaacaatgcccttacaaaacttttttgacatcaacacctgccttataccattttgtgttgctcaaaataaatacctgaggatgggtaatttatacagaaaaaccatttagttggttctcaattctgatggctgggaagttcaagattggacatctgtgtcaggtgagggcctcaggctgcttccactcatggcagaagatgaaggggagctggtgtgtgcagagctcacatgatgagagagagaaagagagcagaaaggtctcaggctctttttaacgaccagctctggcaggagctgatagacgacacactcagcctcaaggaaggagattaatctgttaatacgggatttggtcatatgacccaaacacttcccattaggccccatctccaacattggggatcaaatttcaacatgaggtttagaggggacaaacatccaaaccatagcaatacccttaagaacaataaccttaccaatagtacccttatcaaaaatgcccttaacaacagctttcttagcaacagtacagttactaacagcactcatagcaaaaccttaatcttcaataacacttttaatatcaatgcctttaagaatgacaatcttgaccagatatggtgactaatgtctgtaatcccagcactttgaaaggttgaggcaggaagtttgcttgaggccggcagtttgaggtcagtctgggcaatatagtgagatgctgtctctacaaaaaatttttttaaaaagtccggtatggtgacctgtgctcgtagtcctagctacttgggaggctgaggtgagaaaattgctggagcacaagagtttgaggttagtgaaccatgatcataccactgcactccagcttgggcgacagagctagactctgcctgttttttttttaaaaaaaaaaaaaaaaaaaaaaaagaggaccttcaaaattgcttccatcaacaattacctttgcaaactttccatcaacagcaatgctcctagcaagaacatcttttgcaacaatgcttttaacatatctcattttgcaacatagaaacaaatgcagttaggaacagcatccttaacaacaactttctttacaacgatattaacacaagagtcttgcaacacccttaacaacaagtttcctttgcaacagggccataacatcaacactcttggtaattgcattggtaccaaaacttatctgtgacaatatcttgaacattaatgcctttaagagaaatgctcttaaaaatatctttagcaagcatttccttagcaaacacgctcctagcaacagagagtaagttttgtaagggcatgtgaatatgaaggcagagactggagtgatgccaagaaatgtgaaagatttccaggaaccatcagaagcaaggaaaaacgcacggaaaagattcagagtgctcagaaggaagcaaccctaccaccacctgatttggacttctaagctccagaactgtaagataaatttcttttgttttaagccacctcgtttttggtactttgatgtgacagccctaggaaactaatacaattctcttaacaaaaaggcaacaatttccttagcaataataaacttagaaataatgccttctcaataatgactttgccaacaatggccatagcagccacaccctcagcaaaagcaacttagtgcagatttcttagcaaagcacgccaaaacacactaacaaacatactaagaaaacacaaaacacactaatactaacaaagaaagtgcctttctaaaaactgcctaacatcaacaatcttatcaacacatttcatagcaaaaatttccttagcacctttgcccctagcaatgttgtctttagcaacagttttcgtggcagtagtgaccatccaaccttgatttagcaaatgcatccttagcaaaaactttcttgcaacaccacccttaatactaacacctttaagaacgatgtctttagcataagggccctctcaacaatatcattagcaaaagcttggcaaaatgtgcttagcaaccgcactctttgaaaaagttccattaatagcaacatacttaataacaatgtctttagcaacggtggccataggaattgctccttctgcaagagtggctactgtaattgtgaccagagcaataatggccatatcagccatgcatttagttacagtggcagtaacaactatgtccttggtggcagtatgtgtggggaacatttcttagcaacaacacccttatctaagaggccctaggagcaaaatccattgcaacactatatgcagcaacaatgtccttaattattaggttgatgcaaaggtaattgcgatttttgccatttcagtggcaaaaaccgcaatcacctttgtaccaacctaatacaattcccttggcgacaatcttcttagcaacaacacccttggcaacaaagctcttagcaatatccttagaaacattgtctttagcaacatttcttagcaatggtgcccatagcaacagttccctagtaacagcaaccttaggagaaactccctttgcaagagcacatttaacatcactgcctttaatgaaaaaccacttaataaagaagtcctggctgggcgcgctggctcacgcctgtaatcccagcactttgggaggccgaggtgggcagatcacgaggtcaggagatcaagaccatcctggctaacatggtgaaaccccgtctccactaaaaatacaaaaaattacctgggcgtggtggcaggtgcctgtagtcccagtactcgggaagctgaggcaggagaatggcgtaaacccgggaggcggagcttgcagtgagcggagattgcgccactgcactccagcctgggcgacagagcgagactccatcgatggcctgatggcctgcaggtgtctgttggcctgctcttccgccagtgtgctttcgatgaccagctgcttgtgtcttcttctgctgatgtgttccttatgatgtccagctgcttgtgtccatgccttgctaaggtctctggtttttataggcccatgatgggggcacagcaggccagggtggtcttggaaaatgctacatttcggcatgaaagcagaagtgcctgtccttacctaggtctgtgggggtggagccctagccagggaccacgccctcctctacccagcacttcccttctccccttccctatcatttaaagggaccacgctcttcccttcccagcacttccatatcagtttggtacacaggtaaactcgtgtcatcgaggtttgttgtacagattgtttcatcacccaggtattaagcctaatgcccatttgttattttccccgttcttctctctcctcctatcctccaccctcatgtttccctctgtgtgtccatatgctctcatcgtttagctcccactataagtgagaacatgctgtatttggttttctgttcctgtattagtttgctaaggataatggcctccagctccattaatgtttgcgcaaaggacatgatcttattcttttttatagctgcatagttttccatggtgtatatgtactacattttctttatccagtctatcattgttgggcatttagggtgattccatgtccttgctgttatgaatagtgctgcagtgaacatacgtgtgtatgtggctttataatagaatgatttatgttcttttgggtatatgcccagtaatgggattgctgggctgaatgacatttctgtcttcaggtctttgaggaatcatcacactgtcttccaaaatagtagaactaatttacactcccaccaacattgtataattgttcctttttctccacaacttcaccagcatctgtttttttttttttttttttttttgctttttgctttttaataatagccattctgatgagaacacatggacacatagagggtagcaacacacactgtggtatctcaaagggtggagggtgggaggagggagaaggtcaggaaagataactaatgagtactaggcttaatacctgggagatgaaataatctgtacaataactccccatgtcacaggtttacctgtgtaacaaaccttcacatgtaaccctgaacttaaaataaaagttaaaaaaataattaccaattaaaagaagaaatttcaggtttttaaaaagaaattgtaacagttctgctgaacaatgtttcaggatatcattttcttttagaaaaacatgtattgtgctgctgtagggtggagtgttctataaatgttaggtatagtttataatgttttattattttaaaaaatcaccattctgactggtgtgagatggtatctcactgtggttttgatttgcatttctctaatgatcactgatattgagctttttttcatatgattgttggccgcatgtatgtcttcctttaaaaagtatctgttcatgtccttttcccactttaatggggttggttttttcttgtaaattagtttaagttccttatagatgctgggtattggacctttgtcagatgcatagtttgcaaatattttcttgcattctgtaggttgtctgttgactctgttgatagtttcttttgctgtgcagaaggtctttagtttaattagatcccatttgtcaatgtttgtttctgttacaattgctttttgtgtctttatcatgaaatctttgcctgtgactgttctgaatggtattgcctaggttgtcttccaggatttctatagttttgggttttacatttaagtctttaatccatcttgagctaattttttaatatggtgtaaggaagaagttcaatttcaatcttctgtatatggctagccagttatcctagcaccatttattgaatagggaatattttccccattgcttgcttttgtcaggtttgttgaagatcagatagttgtaggtgtgtggtcttacttgtgggttctctattctgttccattggtttatgtgtctgtaccaataataaatttgtacaaataaatttgtaccagtactatgttttttggttactgtagccctgtagtatagctcaaagtcgggtagcgtgatgcctccagctttgttgtttttgcttaagattgccttggctatttgtgctcttatttggttccatatgaatattaaaagagttttttttatagttctgtgaagaatgtcagtgatagtttaacaggcatagcattgaatctgtaaattgcattgggcagtatggccattttaacaatattgactctttttttctctctctctcttttgagatggagtctggctctgtcgccaggttggagtgcagtggcacaatcttgactcactgcaacctccgcctcccagattcaagcgattctcctgcttcagcctcccgagtagctgggactacaggcgcacaacaccatgcccagctagtttttgtatttttagtagagacggggtttcaccatgttggccaggatggtctcaatctcttgacctcatgatctgcccatctcagcctcccaaagtgctaggattacaggtgtgagccactgtgcctggccaacaatattgattcttcttatccatgggcatagaatgtttttccatttgtttgtgccttctctgatttatttgagcagtggtttgtagttctccttgtagagacctttcacctcccttgttagctgtattcttaggtattttattctttttgttgcagttgtgaatgggagtttgttcctgatttggctcttggcttgacttttgttggtgtataggaatgctagtaatttttgcaccttgattttgtatcccgagattttcctgaagttgcttatcagcttaataagcttttgggttgagactatggggttttctagaaatatgatcatgtcatctgcaaacagggatagttgacttcttctcttactatttgaaagttctttatttctttatcttgcctgattgccctggccagaacttccaatactatatttaataggagtagtgagagagggcaaccttgtcttgtgccagtttccaaggggaatgcttccagcttttgcccattaagtatgatattagctgtgggtttatcatatatggtgcttattcttttgaggtatgtttcttcaatacctagtttattgagagtttttaacatgaatgaatgttgaattttattgaaagccttttctgtatcttttgagataatcatatggttttggcctttagttctgtttatgtgatgaataacatttattggtttgtgtaggttgaaccaaccttgtatcccggggatgaagtctaattgaccgtggtggatacgccttttgatctgctgctcaattcggtttgccagtattttgttgaggatttttacatcaacattcatcaagaatattggcctgaagttttttgttgttgttgttgttgtatatctgccaggttttggtatctggatgatgctggcctcatagaaggagtttgggaggaatccctcctcctcaatttttttgaatagttttggtatgagtaataccagctcttctttgtacatctggtaggattcagctgtgcatctgtctagtcctgggccttttttggttgacaggctacttattactgattcaagtttggagcttatttttggtctgttcggggactcaatttcttcctggttcagtcttgggagggtgtatgtgtccaggcatttatccatttctactagattttctagtttatatgcatagaggtgttcataatattctctgatagttatttgtatttctgtggggtcagtggtaatattgcccttgttgtttctgattgtttatttgaatcttctttcttttcttttttgttagtctagctagtggtctattttaattttttcagaaaatcatctcctggatgtctctatctccttcagtctgcctgtgtgcagttctagtttcagtctgtttcagagctcaagcttgaatacataagaagaaagaagaagactgagaagaaggagaaggaggggtggaagaggaggaataagagaggagaaataagaaggagagagggagggaggaagaagggaaagaggaaggatgatgagagggagggaaggaaagaggaagggaaggaaggaggaaatcaagttaggcaaatcaccgctaggtcatccttcaggtcctgagctccataccaagttcaggggtacatgtgtagctattaaaatgggaaaggttcccttgtcccttttgcagggcatgtgatggaggtgtggcttgcttcttcagtgcttcagtgccccgctggtcaaacctctaggggagcatacagacaggctgtggggcttcaaccccatggcaatgtctaggggtgaatgtttactactcttatccaacgttcagagtcttctgttagtaacattatgcattttgaccatgattatcagtgtaatcagtagataaggcagaatgtgtctactcaatctgaaccaaactggaactctgcaattgggatgtgtgcaactgtgcaccttcaaaatgtccatgttgaaattttagagcaactgattaatatgaccaaaagtacttaagagaaaagtttcaaaacactaattctaattataccagctcttgttcttttttatgttcatgcttaatattttctttctttatttattttattttttatttttttgagacagagtcttgctccacccaggctggagtgtagtggtgcaatctcagctcactgcaatctctgcctcctgggttcacacaattctctgcctcagcctccagagtagctgggattacaggtgcctgccaccagtcatagctagtttttgtatttttagtaaagatggggtttcgccatcttggccaagctggtcttgaactcttgacctcataatacacctgccttggcctctcaaagtgctgggattacaggtgtgagccaccatgcccagccatacttaatattttaatttcaaattttatatatgaatgtatgtatgtgtcagtatatatattctatgtacatattgtgtgtgtgtatatatacacacacacacacacagagagagagggaggaaggatataaaaattatatcaaagaagaatgtagtgctatttaaaccaaagaacacacgcacagctcttactattataatcatagaaaaaaatgaactgacattaaagggcattttaaatgttcatatattttgtctcttttactcagctactaaaatactcaaaatgtggtaagattctctaatgtttatatagtagaggttttttgtctttgtttaactagttgagttggattgcttatcatacaattgagagcttcgaatatcagaacagttacttacatgccaaaattgcttatgaatgttctgtcatgtcaaagttgttccattaccatatagaagtaaactctgatctgtatagatactaccagatgggtgtggtggcacatgcctgtagtctcagttacatgggaggctgaggtggaagggtcacctgagcctgggaggttgaggctgcagtgagctgcgatcacaccactgtactccagactgaatgacagagtgagaccctgtctcaaatgaaaaataaaatgatattactagaatatacttgtctaaacttttactttgagaaaacagaaaatcaaacacattgttctcacggtgttaactttcaaagaaatgatctgtaatttatctggtggaattcaatgcagttattttgtttataacatttttcaaaagctgcggttttccctgggtgtgtgtgggcacaattccattgtgataacactcatcttttgcagagtgctgaaagagtgagccaggacagccttttgacattgaacaaggcaattcccaatctcttggtgggtgaatggaggaagagtgatatcctgattgatgcctctacaattacttaaaaatatttggacactctagaaaattactctttttggaccatcccctcaggtcccttaaatatctgtgtccctttactgagcagcaatttgggtcagaaaaaatgggctctgaggatgctcagaaacaaaagtgttttggggagaaagatatggttctgaaggcctggagaggcaaaccatgtccagaaaaggtcccagatgatagaactccctgagtattcttgcagaaatgaatatccaccaggcttcttcttttttttttttttttttttgagatggagtctgtctctgtcgcccaggctggcgtgcaatggcgcgatcttggctcaatgcaagctccgcctcccaggttcacgctattctcctgcctcagcctcccaagtagctgggactacaggtgcctgccaccatgcccggctaattttttttgtatttttcgtagagacggggtttcaccgtgttagccaggttggtctcgatctcctgacctcgtgatccacccgcctcggcctcccaaagtgctgggattacaggcgtgagccaccgtgcccggccccttgtttttcaatcacaagatatgagtcattgcaggaaacaaataaaatggaaccaacacagagaaaggtagagatggaagaggtaagactaaattctagagatgctgcttattccctaaggtctgtcctttagcattttgtaacatgagttaaagtacatttgagttgtgtctttgtaatttgcatccaacagagccctggctgtgttcactgaatggatctagtctctgaaaattcaccgacatttttggcttggcgctgtggctcatgcctgtaatcccagcactttgggaggttgagacgggaagattacgaggtcaagagatcaagactatcctgggcaacatgatgaaacgctgtctctactaaaaacacaaaaaattagctgggtgtggtggtgcgagcctgtagtcccagctactcaggaggcttaagcaggagaattgcttgaacccaggaggcggcggttgcagtgagccaaggtggcgccaccgctctccagcctggcaacagaacgtgactccgtctcaaaaaaagaaaaaaaaaaaatttcaggggtatttatgtagtgacctgttatttgatttttcaataacataaatctgtttcaagaaaaagaaattttaaacaaactcttatgattttctttctcctgaaaattattccagaacttaaaaaaaagaagaaacaaaacagagtaagtacattagctttattcaacataccatcttgtctagtagtaaactactaaaaacagtctcctgagtggaaaaaatataaatttttgtctatttaacaagtaatagcatcagtgttgtcctgcgtgttctcattattttctccaaataaattggctcaatatgctgctaagtattaccatttatgtttattttgaagttctatatcttgtctttgctgtttcatctgtaaacaggcaattattgcctcaatgtgtattctgatacattttctctctaaatctattgtccaacatcttgcatataaaatctggcttttctctcatatatcaaaatcacaggtcacatagtctcagtgccaagagttacaagaacaactgctttatttcactcccatctctgtgaatacaaaacttcaatctctaaagtattttgtatctatttataacactatgttcctggcttattattatattatttcattattagttcttaaaaacttaaggtgctgaataattttgtgaaatattccatggagaactaccattaaaatagtgattattttaattatatttcatcacctcatttcacaagtcattacaaaacttcttaattgtttaaaaatgaatgtacttgggtggggcacagtggctcacacctgtagtcccagcactttgggaggccgaggaggccagatcacctgaggtcaggagtttgagaccagcctggtcaacatggtgaaaccctgcctctactcaaattacaaaaattagccgggcatggtggcacatgcctgtaatcccagctactcaggaggctgaggtaggagaattgcttgaacccaggagatggaggttgcagttagccgagatcatgccactccagcctggccgacagagcaagactctgtctaacaaaaaaaaaaaaaaaaaggaatgtacttatcagtccaagggaaatagctatcaaattagtcactgcccaagtatacgtcttttagtgaacacaaattgagaatttagcactgaatctccaaagatttagtttttatctaggttttgaaattgaattttgttttgttttgttttttgttttgagacagtgtcgctctgtcgccgaggctggagtgcagcggcgcaatctcggctcactgcaggctccgccccccgggttcacgccattctctcgcctcagcctcccgagtagctgggactacaggcacccggctaattttttgtattttttatagagacggggttctcaccgtgttagccaggatggtcttgatctcctgacctcgtgatccgcctgcctgggcctcccaaagtgctgggattacaggcgtgagccaccgcgcccagcttgaaattgtattcttaaatctcagaaggctgaagctttcaagacaggaagaagacagggattcccgagttgaacagagagtgggccgggcgcagtggctaacgcctgtaatcccagcattttgggaggccgaggcaggtggattccgaggtcaggagatcaagaccatcctggctaacacagtgaaaccccatctctactaaaaatacaaaaaattcaccgggcgtgggggctcacgtctgtaatcccagctacttgggaggctgaggcaggagaatggcatgaacccgggaggtggaggttgcagtgagccgagatcaggccactgccctctagactgggcgacagagcgagactgtgtctcaaaaaaaaaaaaaaaaaaaaaaaaaagaccggacgcagtggctcaggcctgtaatcccagcactttgggaggctgaggcgggtggatcacgaggtcaagagatcgagaccatcctggccaacatggtaaaatcccgtctctattaaaaatataaaaattagctgggcgtggtggcaggcacctgtagtcccagctactccggaggctgaggcaggagaatcgcttgaacccgggaagtggaggttgcagtgagccgagatcatgccattgcactccagcctgggcaacagagtgagaaaccctctcgaaaaagaaaaaacaaaaacaaaacaaaacaaaaagataataaacaagaaaatactaatgtagttgttaactttcagaaggcagtaatttaagacatggatgtgaatgcagataatggaagtaaggagagatcagtgtaggccacagtcctgtgctgagtgctgtctttacctgtcttgtagggatggctcagacaaagtcttaacaaacaggcaaatgactgatttatctttttagattctaaagttcataagaataataatgagctttatagttgacaatagctaactaaaatttggtctaaggggaaaagagcgcttaatgttaatcagtcagtttaatctttctgtaaaccctctcaaaaagcaaaattgaattagatcattgtggtgcactgattcttttggtatgtgtgtcccacctataataaagttctgggccaggtgcggtggctgacgcctgtaaccccagcactttgggaggccgaggcgggcggatcacaaggtcagaagatcgagaccatcctggctaatgcggtgaaaccccgtctctacttaagaaatacaaaaattggccggacgtggtggcgggcgtctgtagtcccagctactcaggaggctgaggcaggagaatggctgagctttcagtgagccgagatcacaccactgcactccagcctgggcgacagagccagactctgtctcaaaaacataaataaataaaataataaataaataaagttattggccaggagcggtggcttacacctgtaatcccagcactttgggtggccaaggtgggtggatcacctgaggtcaggagttcaagaccagcctggccaacatggtagaacttccctctctactaaaaatacaaaaattagccaggcatggtggcgcaaatctgtaatctcagctactcaggaggctgagacaggagactcgcttgaatccaggaggcagaggttgcagtgggccgagactgcaccactgcactccagcctgggtgacagagtgagatgctgtctcaaaaaaaaaaaaaaaaatttatctgaagactgaccccacaatggtgagccctgcctgccatgtttgtgttatggaatcatgtcccatacctgaccctatttatttaaaggtagaacaactgacccaaccacattttctctttaaaatgtgggaattgggattgagagatactggtctttccctatgggtcatttcaacttagaatatttaagtttgggatcgttggtgcttccatatttaaccagcagcttagaaaagcagacatagtcgatctgtggaaagaaaagctgaagtgatgtggagagagaagttgtgaaaagcgatcagagcgcctgggagagatttacttagggtagctggagctgttcctggagctctttccagactttggttctagctcttgaagctaccaggcttccagcctttagaataattccattttaacctcagagattttgcgctggttcaacaccaaacaaaagaacactgaataagacagtaatgtgagtagaaaattctatgaaatagaaaagaaacttaatgatgcgtcataggccattgatattcactttcctccgtcccatgtatatagatcacttcgcctcttccaaaattcttatttcataataaagattaactagttatttaaaagttaaccatagcctatttattgtttattaacgaacgtgtttaaaaggatcaggtgctaaaccttggaagaatattaaggcaagatgttatgagatcacagaagcttagtgctgaagggtccatgccttcacgtgggtacagattcctctctgagtgctcattcacccattgtggtgtgagccctgtgtgaaaactcttcagatgcagacatgaataagacaaggtgtctgctcaaagtcaactagaggagacagtaagcaaataattagaatgtggaacatgccataatcgaagtggatgggtgtcatgggagcacagatcatggggtatctaactttgctttggaggttaaagtatagcagtcatgaagacttcaaaggggaggtggatttttattggaactgttgagaataaacaaggatatacatattttcaactatggcctgagcgtatatgagctttaagagctgaactgttgggggcattccagaccaagaggaagtcgtgggcagaggcaggaaggtgaaaggagtatgctgtttttgggagaagcatagttagtgcagaggggctatgactcagggcacacaggatggcagagtgtgtctgggagatgaaactggcttacaggcaggaagtgaggaagaaaggactttctgaacttcttatggaatttagacttctatagataacagagaatcactgtatgaatacactgtcatacattctttgagagaaaacacattcatttttgagaatcctcattcctgaattctttttgtctgtggtacagcttcctgcagccccatccaccaattacagacctatcttcttagtgtgagtctaatgtctcctccatgggagggagctgtagaatttaaagttgaccatcctgctcatgcctgagttttctctctcctgcaactaacgccttcctctctgtctgagacctggcatgtcagggtagaaggcccttcaccctccttctcttgacaaactctgatttattgacatcttactgaatatccaatggctggaactgggatcaagctcttcagtgtggtctgaagctgggggcaggagagacctcactcccttcaaattcactaagatatgaggtgacctcatcataccacaggcttttgtcaaggccacagggacataaactcaggtcacttttgtttcacaggcattattctaatatttgtggggttttttttgtttgtttgttttttgagatggagtctcactctgtcacccaggctggagtgcagtggcacaatctcggctcactgcagccccgcctcctgggttcaagcgaatcttctccctcagcctcccgagtagctgggagcacaggtgcacaccaccacgcccagctaatttttgtatttttagtagagacagagtttcaccatattggccaggcaggctggtctcgaactgctgacctcgtgatcttcctacctcggcctcccaaagtgctgagattacaggtgtgagccaccacgcccggcctaaatttgtgtatttttaaactaaagtgtcaaactacatttatcgccctcttcttagtttggaaaagtgctttgtttctgttaagactgttttaggttttatctcttcaccacacacaggctgctccttccagttcagtattagctgaggatttcatttcagtcctcatacagagcagtgataacagctgaataaaccagagctgaaagtgggcccatgtccctctttcctacctctctttcacacctgagtctgattgagtgcagtatgcaacttggatgagcgtgtgtatgcaaagtgcacgtcagcaatgaccatagctggaacaggatggagctagccacctctttatcatctccctgctcattctttgatgcagaaaactaaccttgtctcaagcatgtgtaaataattcatgcaaagttacaagacatggttcaagtcatgccccctccaaccacatcagcaccatgagcagtccttgagggtcttcagataataacaacactaagagttagcatatgttgaatgctgtactatgtatgtcattctaaggggagaagctatgtagaaccaaaagtaagcacaggcagcttcaagcagcacacagaaacgcaacacaggaggtggcttatttgattgtcattgaagttgtgaaaaagtgttaaaaataataaatacaatagtttaaaaaagaaacaaggaaagtattatataccataacaaagtgggatgcactccagaatgcaagcctagttcaacagtcaaagatcggtccattataccaatgggttaaagaagaaaaatcatgtaatcttatcaatagatgcataaaaagaatttgacaatatctaacaatcattcatgataaaaactttcagcaggctgggtgtggtggctcatgcctgtaatcccagcactttgggaggccaaggcaggcagatcacgaggctaggaaatcgagaccatcctggctaacacagtgaaacctcaactctactaaaaatacaaaaaaaaaaaaaaaaattagccgggcatgatagcgcgcacctatatcccagctactcaagaagctgagacaggagaatcgcttgaacccaggaagcggaggttgcagtgagccgagatcacaccactgccctccagcctgggggacagagtgagactctgcctcaaaaaacaaaacaaacaaacagacaaaacaaaaactttcagcaaactagcaatagagagaaacttcttcaaattgattttttaaatctaaaaaacccctccacttaacatgatactcaagcctgaaaagtgagatactttcccactaagaacaggaacaaaacaaggatgtctcctcttatcactcttatttaactttgtgtggaaagtcctaactaatgcaataagacagaaaaaagaaataaaaggtatacagataagaaaggaagtgatagcggagcgcagtggctaacgcctgtaatcccagcactttgggatatcgagggaggcggatcacgagaccaggagatcgagaccatcctggctaacatggcgaaaccccgtctctactaaaaatacaaaaaattagccaggcgtggtggcaggcgcctgtagtcccagctactcgggagactgaggcaggagagtggcatgaatctgggaggcagagcttgcagtgagccgagatcgagccactgcactccagcctgggtgacagagcgagactctgtctcaaaaaaaaaaaaaaaaaaaaaagaagaaaggaagtgataaaactgtctttgttcatatatgccatgagtgcctatgtagaaaatcacaaagaataaacaactcctagaatgaatgctatgtatataatcttttataagtgattacagcaaggatgaaggatacaaagttaatttacaaaagtcatttctttttctatatgccatcaatgaacagttgaaatttaaaattaaaaacacagtgccatttacattagcaccaaaaatgaaatacttaggtataagtctaacaaaatatgtgtagtatctatctgaggaaaactatgaaaatctgatgaacgaaaccacagaagatctaaaaaatcgacttactgcatgttaatgaataagaaaattcaatattgttaagatatcagttctttcaacttgatctacagatcagtattgggatcaatgcagtacttatcaaaatccaagcaagctactttgtagatattgactagctgactccaaatctatagaaagtcacgagatgcagaaaagccaacataatattaaagaagaacaaaattagagaactaatgcttaatgacttcaaagggcttactgtaaacttacagtaatcaagagagtgttgtattggtaaagaatagacaaatagatcaatggaatagaacacagagtacagatagagaccctcacaaatatagtcaatagatctttgacaaataagcaaaggtaattcaatgggaaaaagatatggttcttaacaaatggtgttaaaactactggacaaccacatgtaaaaaatgaatctagatactgaccttatacttctcacaaaaattaactcaaaatggatcatagacttaaatttaaaggcaaaactataaaacttctaaaagatagcaggagaaaatacaggtgaccttgggtttgactatgagtttttaattacaaccctatagtgtgacctatagaagaaaaacttgctaagtgggactttattataattaaaaaaataaaaaaaaacttctactgcatgggtgacactgttaaaagaattagaaaacaagtcacagggagggagaacatatctgataaagggctagtattcaaaatatacagagaatacttgaaactctacaataagaaaacaaataatccaacttaaaagtgggcaaaaggccgggcgtggtggctcacacctgtaatcccagcactttgggaggcaaaggtgagaggatcacgaggtcaggagttcaagaccagcctgaacaacacagtgaaacctcatctctactgaaaatacaaaaattagctgggcctggtggcacgtgcctgtaatcccagctactgaggaggctgaggcaggagaactgcttgaacctgggaggcggaggttgcagtgagccaagatcgcaccactgcactccagcctgtgtgacagagcaagactgcatctcaaaaagaaacaaaaaaagtagctggaatcatacagtatgtatgttgatattatttttccagctatattataaactccacatgggcaacgtatattccctaccttatataatgtataatatatacaatatgtacctggtataatgtataatatgtacatatttaataaacactcattattataaatattcacaaatatacataataaatgttctctaatcaaccacatagagtttttttaacacctttgaataatgcaataggaacaatctattaaaataaaacagaaaaatattcaaatttaaatgaaacaaagcaactgccaaattattaaatccaagttccttattttaggcgtcaaatgcaaatattcttatagcttttattgcacatacatgttggcggtcatggtaaaagaagatacaactctcaacttcaataaaatgtatttcaatattcaataaaatttcaatattataagaaaaccaaaatgttgtgttagtaccaggacagttgcatttgtaagtacttgtgatttctttttctttctttcttttttttttttctgagatggagtcttgccttgttgcccaggctggagtgcagtggcgccatctcagctcactgcaagctccgcctcccaggttcacgccattctcctgccacagtctcccgagtagctgggactacaggcgcccgccaccatgcccggctaattttttgtatttttttttttagtagagacggggtttcaccgtgttagccaagatggtctcgatctcttgaccccacgatccacccgcctcccaaagtgctgggattacaggcgtgagccactgcgcccggcccatacttgtgatttcacgtgcacagtgagagtttgactctttcatcctcgcccaaatactttttcatcccatgactgttgggcttttgtttccctttctttctttctttttttaagattgcaactccatcaatactgggatgtctattcaagctagctaaatatgttgattaacttctccactcccagcacctcctagaatcccactgcaataacaacaaataagaacaaaggggccgggcgcagtggctcaagcctgtaatcccagcagtttgggaggccgaggcgagtggatcgcttgaggccaggagctcaagaccagcctggccaacacggcaaaaccccgtctctactgaaaatataaaaactagccaggcgtgttggtgcgcgcctgtaatcccagctactcaggaagctgaggcagaagagcttgaacctgggaggcggaggttgcagtgagcccagatagcgccaatgcacaccagcctgggccacagagtgagactctgtctcaaaaaaattaaaaggaacaaaatgaacccatttatacaaagactacaagggtggagagacttggatagcatgcaggatattcacaagcaattctggaagaaaaatgacagatgagtgcattctgttattaaaatcacagctcagagtcctcccaggaaatggctgcggtgtgtagggagctgtctttcacagtgatgaaaagaactctaggttcagagtgggcaggtatctggaagaacattttttcgccagcatccctttatttattgatacgtcgatgagaatagtaccacagcccaatgacatttatcatttcagttggcagtgtctctgagagcaagctgcaagatttccaagccttcactgagtcttctactgacatttagcttaatcttgacaagtatatctgactactgcaatgtgttaatgatcaaggagtatgtcaaattataacatgtctgctgcaggaaattatggggtaatacagacagtgtgcactggatcaaccattatctatgcctggtgttatgacaaaaagtgattgattttggcatcaaaattaaagtgttcgtctggttcaacttgttctttgtacaccgtccttcattatgacaagcacatatagcaaaaatactgtcttcaatatgaactgttgattattgattaaacagatcacatttggatgggctgcagtttctgcatgtctaacgggtgggatccttctgagaatgctagaatagggaatcatgacaccgagccacttcagtcatagaccttattcttgcacttttttttcttgctggcaattttacatagcaggttgagaaagctactctatgctagtatagactatacaccaataattttgataatgagttccaggatgtatttttcttcttatatattttccttcctaccatgatactagtaatttataaggggtctgtgtagtttgaatgtatttgaataactttagctctactgtttgatttgaaccaaagaagcgaagaggacgtaaatattcccatttagaagcccaaagtcagtgagatgaaacccaacatcaagaaattgaagcaaagttacttgtggataaagaaagcattaggtaagttgtctagagcataataattagattttctggctttcaaaaatttggattgcaataagaggaaacttcatgctatttttacaattttcagtacaaaggggtgtatatctagaaacaataaagttgacatatttgagtaccttttcaaaaaaaggtaaccataacctattttttttttttttattaaaaggaccaggtgctaaaccttggaagaatattgaggcaagagtattaaggcattttaattcagcttaagtatcatgttaagtcgtggaattcagatgtaatagaatgcataaaagtgttaatcaccagtgcttaagatggcccacagaggttgttctaccaggcatatagaaatctttctcactatgcctgtttgtgagcaggatcagtggttttgcactgcaggcacacatttcattttgtcaaatatttttgcaacctcccctctacttaatagtttaatcactacatctatacaaactacttggtcaatgagggcccattttacttgtgtcttccagaaatattttgcattaccccaaatgacatcttccagcagatcttcctcagatataaagtttccaaaaaactggcaaataaaattactatcttcagaacttttctgtatttaaaaataacaataaaaagctatgaatttacataaaattcaaaccattgtgtttatagccacagtcctccacacaattttcatgacaccattggtaaaatcatgtataagcaacattcctttattcctagaaagtgtttatatttcaaaagcactttatttttcttcagatattcccctgaagaaatttggaaagaaattgaaattgcctgtggttgtagccaattcacctgtaaagaatataaaattctccccatgaactggtcatcccagtgtcacacttacaagtctgagaaaagtgcaagaggttattgggaagtattccttcctttttcaattttctctttaattggaataattggtaagaactagcagaattggtatcatatttttcttaaatgtttggtagaattcttcactgaagccatttagacctagcattggagtctttgtggaaaggttttaaattacagcttcaatttctttaatagataccgggctattctgtctatttgtttttgagtaagactagataattgtgtctttggagaaatttgtccacttcatctaagttgtcaaatctgttggcacaatgttgttcataattaccatttattatctctttagcatctgttgaatctgttgttatgttacttctcttattcctgataggttgtttttgtattctctctttttttcctgataagcctgaatagaagtttatcaatactatggaccttctcaaagagacagagtttggtttcatttatttcctgtaaatgatttttcctgttttctattgcattgatttctacactgatgctttttacttcctttcttctgcttactgttggttttattttcttttctagtttctttttttttttttttttttttttttgagatggagttttgctcttgtaacccaggctggagtgcaatggcaggatctcggctcaccgcaacctccccctcctgggttcaagcgattttcctgcctcagcctcccgagtagctgggattacaggcatgcatcaccacacccggctaattttgtatttttagtagagactgggtttctccatgttggtcaggctggttgaacttctgacctgaggtgatctgcccgcctcagcctcccaaagtgttgggattacaggcatgagccaccatgcccagcctcatacctgattttattgtcctttgctttactgcacttctcagatactgcattttttataaattgaaggcatgtggcaaccctgcattgagcaagtctatcagcaccattttctccaatagcatgtgctcactttgtgtcactgtatcacatctggtaactcttgcaatattttaaatttgtattattatgtgttatgtgatctgtgatcagtaatctttgatgttactattgtaattgttttggggtgccacgactgtgccaatataagatgacaaacttgccagtaaatatgtgtattctgactgctccaccaaccatcccccatctcttttttcctctcttcaggcctctgtattccctgaaacagaacagtattgaaattaggccaattaacaatcctacaattgcctctaagtgttcaaatgaaaggacgaatcacgtatttctcactttaagtcaaaagctagaaatgattgagctgagtgaggaaggcatcctggaaaccaagatagacgcgaagctaggcctctttcaccaaacagttggccaagctgtgcatgcaaagagaatgttcctggaggaaattaaaagtgctactccagtaaacacacaagtgatgagaaagtgaaacagacttattgctgatatggagaaagtttgagtgctctggacagaaaatcaaaccagccacaacattcccttaaaccaaagcctaatccagaggaaggccctaactctcttcagttctatgaaggctgagagaggtgaggaagctgaagaagaaaagttggaaggtagtagaggttggttcgtgaggtttaaggaaagaagccatctccgtaaattagcttttaaaacttttttaagcaggcaatctctgactttgcttcagtaacatttccttctcctgctctttctcattttcccattgctcatgcttatacctgcccatctttctctagtattaaagtttggataaatgtttgatctttgaataatattttatattgttatatgcctctgattttatcctctggacaaacttgagagacagtgcaaaaatttctttatatctttataatataaagaattatggcaaattttaaaagaagtaccagccttattgaggtataatttacgtataataaactgcaccctctccaccccctcccctcactgtctaccaaaaaatgtctgatgatatcctggcaatctgaccctgcctggaaaacaccatagagaaagacagcaatgtgcttcctcactctggagttctattggattttaatggccatagatgtattatgagccacacaaaccagcactaaagtagagaattttttccagaaaaggtgtgctaaaaaagcatgtaaacgaaagcttttatttgttttattttcagcaaccaagacataaaattattaggtaggccatgatacacaaacactaaccactgtaccatcctttgatgttcattgcaatggattcaatgtttgtgccccccacaaaaattcatatgttgaaatcctagcccccaaagtgatgagattagaagggaggattgctgagaagtgattcagtcacgatgggccctcggaaatgggattagtgctcttatcaaagagactaggagcactggcttgcccctatcaccacatgaggacacagcaagaaagcacccatttatgaaccagaaagcaggccttcaccagacactgaatcttccaatgccgtgatcttggacttcccagcctccagaacgataagaaacacatttctgtggtttataagtcacccggtctatggtattttgttgtagcatcccaaatggacgaagacatagttcactgtcagttcaattgaccatgaaggattatggggcctgcgtgtccctggcactgtgataggaactgaggagaacacagatggaaattaataatacttcagcctgtattttaataacgtagagtttagtagaaataaactgaaaggcatagcagggtgaaaaaaaagtgtaagtaatgtactaatatttgttgagccccaccatatgctagactctattgtcttacttatacctctcagcaaacctataagttaggtcctattagctaatttatagatggcaaaataggctcagtgaggtcaagtaacttgccctatgttatagagttatcagtgggaaagttgaaagtggtcaagggctatttatagtcaggagaaattaagcgagtttagagtcattccttttctgtagcattacattagtcctgaaataaagcaaaatgtatcaaattcatataccatatataaatatatatatattttttattattattttaagacagagtttcagtcttgttgcccaggctggagtgcaatggtatgatcttggctcactgcaacctccgcctcctgggttcaagtgattctcctgcctcagcttcccaagtagctgggattataggcatggaccaacacatccggctaattttgtatttttagtagagacatgttggtcaggctggtctcgaactcctgacctcaggtgattcacctgcctcggcctcccaaagtactgggattacaggcatgagccactgcgcctgatcctgtattttagataagaaagatgctttatctgtctcccattggaatacacttttgttgttcgtttttttttaacttaattaaacttgaaagccaacttttgtcaaaacagaagaaaataaagcaattttttaaaaaatccagtatttaaaatacttatcatttataatatatgcatataacagaaaagtagaaaataattctgcattttaaaagcttagcttctacatggcaagtgtgggacataaagttgatacttgactactaactggatatattctagattttcacatttaatgataatggatgtgtgcgtctcatggtcaaactaaaatgatttattttttacaaattatctttatcattagcaaacaagtcttacttttattagtcaattataagtccacagagctataggagctcaatttgttacagggaacttgagcattccatggattatctgagctgaatttgaagaatgtactgtggagatcttctatgtgacatatataaaggatgtaggtcaactactggttattatttagaaaatactttagggaaaaaaattatcttctggggccaataattgagttctattaaactacagaggtagataattttgaaatgagaaatcaaaatatattttgattttatattactcatattttcattttattcataaagtcttttggaaaaagacaacagaaattgtactttgttgagaagactcctagagccaaatagtcacagactcagaacacacagagacaagcaaagatggttccagcaagctctaaggacacagacatgtgaaagaggcgctgaagacacacgaggactgatgcatggtagatgtcattctgatatggctgggcttctggactcactgcctcctccttctagaacccagcacctccaaggctgggagaagagaagtttggggtctatgggaaatgacctctggaagtggctgtgactgtttccaaagacaaatacaatctagattctcaaaacaatgcaaatgaacaaaaaatgtgagtttagcagttagtgaaacattaagatgagatacaggagtaaacacatttttttccataaaagtagtggatgttaaataatgaaatacagtggtaaaacaattacagcctggaggctttaagatgtaaatcaaaaatggagaccagtggtgttaatatcatatgagaggattaaatatgagctgctggtccaactgtgttctgcaggaattcaggcagatggatgagagacaggctatgagtaaagcattaccacagctgggggtgtggtgtatggaagctcatcctagctagcacttggagaagaactcacacattgcaaacatatccggttaaaaactggcatttgctgcaactaaaaaaggcaagtgatggtctaggtgaactgccttttctttctctccttccaaaggacaaaattattattattattttttttgagatggagtcttgctctgtcacccagactggagtgtagtggtgtgatctcagctcactgcaagctctgcctcccaggttcacaccattctcctgcctcagcctcccaagtagctgggactacaggtgcccaccaccacgcctggctaatttttagtattttttagtagagacggggtttcgccatgttagccaggatggtctcaatctcctgacttcgtgatgtgcccgccttggcctcccaaagtgctgggattacaggtgtgagccaccgcacccggccccacaaaattaaattcttaattaaggaaactgtttcttttacatctattttttcatcccaaactcaaatgccaaatatttagctattatacatgtattcattttcttagaatacactctatccagcttgacatttcttttaaattttcccattacataattagattcttgatcctcatgtatgtgatgtttccatcatgtgctgggttttatgctccaaatacatgtcctttcatactttaatggacacaaatgtgctttataaatattttaaaatccattttaaggtaatttattgagtgaaaattctgtgtttggtattttactggggtcagtggtggggtaggagaaggaaaggacatggcttttgccctctaaggaagttgcagggaaactgtctctgatttcattatcaaagcgaggcccctttctatttctccatttcaataccttttctactgacttcagatctatcagatgttataattatttcccacttgtgtttgtgtaactgtgttctgactatccacacattaggtgtgggctctgtgaaagcagggaccatattgatcctgttcaatgtcataccatatccctagcatagaactagtagaggcataacaaagatctgtgaaaaagtaaatgcatgcataactcagttggtcaattaatgtacatcacttggcagaagaataaaaggatcacgagagcagatgaaagaagactttatattttgcagaagaaaattttctgtgtcttcaaatgatcacaaatcaaattaataaagttgatgaggctttcttcaaaatggtgcttgtagaaaaagtgagagaaaggtaaaacaagaggaataatatggatatttagcattctggatgtttgctaagtgacaatttaaccacaagaatacacttcacaggccgggagcggtggctcacacctgtaatcccagcactttgggaagctgaggcaggtgatcacgaggtcaggagatcaagaccatcctggctaacatggtgaaaccccatctctactaaaaatacagaaacaaaattagctgggcgtgatggtgggcgcctgtagtcccagctactcaggaggctgaggcaggagaatggcgtgaacctgggagcttgcagtgagctgagatcacgccactgcactccagcctgggcgacagagcgagactccgtctcaaaaaaaaaaaaaaagagtacatttcactccattgtcaagagagagagatatatatatatatataaaatacatattaaattatgtgtgtgtatatgtatatcttttaagaccaattttattgagatataatttatagacagttaaagtcactaatgttgtgtataatacaattagaattttgacaaatgtgtacatacagttgtataattggtgccaaaatcaagatataaaatatttccattacccataaaaagtttcctcagtcccttttgtggccaatgaatccccatcttcctgcaaccaatggttttctttcagagactatagttttttgttttcaaactttctgtgaatagaatattacactgtgtatttgataattgttttctttcaatcagcatggtgtttttaaattcatctatgttatgtatattactacttcatcctctatttttgcttaacagtattccttttctagctagaaagtagtatcaagatactaaaatatatttgttcatcacttgttgataggcaactataaataaatttattgccataagcatgtgtatacaagctttctgtgagcatatgttttcatttttcctgtataaatttctacaagtgagattttggggtcatatggtaaatcagtaccaaagtattttccaaagtaatgtattatttttcattttcatcagcaatatgtgggagttctagttgttctacatctttaccaatatttggaatcatcaatcttcttaattttagtcattctttttttttttttttttttttttttttttgagatagagtctcgctttgtctcccaggctggagtgcaatggcacaatcttggctcattgcaacctctgcctctcaggttcaagtgattcttctgcctcagcctcccaagtagctgggattacaggtgcctgccaccatgcctggctaatttttgtatttttagtagagacagggtttcaccatattggccaggctggtcttgaactcctgacctcatgatccaccctccttggccttccaaattgctgggattacaggcatgagccactgcgcccggccttgatgacgtctctctttcacttttgttcctgacagtccagactgcacaatttcggatgtgggagactgggtgatttctttgatcttcccaaccaaatatgacttacttaaggattttacctgtaaaatacattattaaaggttaagagaagggtgacaatggtggcctccttagcttaactgaatggttatggtttttagttgtagttgcaatcttatgcttgtgtggttctttgattagtgtttactttctctatcctacactattagcttcatgagaataggaaaattattcctctttgaactcaccattgtattcccaattctagcacagtgcctgggatttcctctgtatgtgtttttgaaatgcacccaatagatccacagacagattttaaaaatataaacatagaaacaaatccttctggtcttgaagcttgaaacttacatttgttttctctgagtttcttcctcaggaaatggactctcagctctctcaaaaagtatcaaagaagtgaaattcatcagaccactgtgtcgagacaatgagatgccagatgccagattccttatttgtcatgattgcttccttagccctccctagttcctgttttcctgctcatagttacatttcttccttgctatataatcccctaatttcggctggttgaggagatggaattgagactgatatcccatatccttagctgtagcatgcaattaaagccttcttccttggcaatattcattgtctaagtgattggctttctgtgtgcaagtaacagaacctagattgaactcctggtatttcagtaacattttgtgtgtaagaaagagggtggaggaaggagagtaggggaaataggaagagtgtcttaatatttttgttgctataacagaataccacagactgagtgatttataaagaaaataaatgtatttagctctgaggcctaggaatgccaagagcatgatgctggcctctggagaaggccttcttgctgcctaacaacatggcagggggcatcacatagtgagagagcaagagcaaaagggcttatgataaggaacccactactatgctagtgacattaatccattcatgagggcaggactgacataaatctattcatgagagaagagggattaagtttccaatctacgaacttttggaggatacattcaaaccatagcagaaagacagacagagatagatatgtaaagagggaacaagcacacatcacacatacaaaaactggacaatatttttataaatgaaatgcctagagcctctctcgtatattgtatttgttgttattttctcaatttaaacttatcactccataatttctctttttcttccaaatgaaaatttcttctcatttctccaaaatgatgtacatgtttcttccttatagccataaaacacagtaattgtttcctggaaaattttaaatgtctcactacaattcaagtatcatacttactatatgttttttatcttctgtgtattttgaaaatgtaagagcattattgtcttatacaaaataggtgctagcagagtgaagagacaaccaaaaataactcaataagaaatggacaaatgatccaaatagacatttttcaaaagaagacatacaggccaacaggcatataaaaaatgctcaatattactaatcattagagaaaggcaaattaaaaacactttgagatatcaccccatacgtgttaggatggttattataaaacgacaaaatataacaagtgttggagaagatttgaaggaaaggcatcatggaaaatagcatggaggttccttcaaaaattaaaaatgaactaccatatgaaccagcaatcccactactgggtatatatccaaaggaaatgaaatccgtatgtcgaagagatatctgcaacaccatatacattaaatcttatttatatattagcccaagatgtggaaacaatgtaagtgtccatcaatggatgaatgaattttaaaaagtagtatatatacacaatgaaatactattcagccataaaaaataatgaaatcttgttatttgtgacaacatggatgaacctggaggacattatgttaaatgaaacaagccaggcacagaaagaccatatgatttcacttttatgtcgaatctgaaaaagctaaactcatagaagtagagagtagactggtggttaccaggagctggacttggggtggggagtggggatgtttatcaaaggattcaaaatttcatttaggagaggggaaatattcaagaagagatctaccgcacaacatggtcactatagttaataacaacatattgtatttttgaaaaaaaatgcaaagaaacaaagtaagtattaaataaaaactggttctttgaagctttggcactgtaatatatgaaggccagaagccacatttatatagttccgtttcttgagcatccaagacaatggatgagatgacagtgttgaggaagacaggtcacccactgtgaacactagattcagcttctccccctgctgtttgactcattctgcagaaggtgagaatttatctgaaggagtttacatatttttatgtgacaatgtattcctgagaagataccaaattctttcttctacatcaaaaatacagcatgaaactgacaagagagcatataaatgatgattttttttaagtttccaggaatatcacatgtatcatattactgaaaagaaaaagagcattttatgccgtgaaaaactttggatatccttgaataatgttgactaaaaacagtgagtttatttagtattcatcgtgtctatatttggagtgtatatttttagtatttgtcatcttgcttatcaaactcctgaatctcacttaaaaagtattttccaaagtttttgaaatttctccaacaaaagaagaaaaaacaaaaaagcaagtattggaagtcaaataggtttgagaaatattatgacacatgtccttcttgcacatcataaagcctctaacacttttcatagtaaaccaataaatgaaactcagacttcttgctttgcttaatcaaaaaattaaagttttccaaacttctttgactacagaatcttttgacaacacaatattgatcattgcacactttgagagatattactctacaaaagtcactgcacagcaccactaaaatatggtgaccgataaaacggacaaaggtcattcagtgaaagtttcaaagcaaagagaatgaatgaatatatatatatatggatgtttactttttggattacagttttcagattatgtttgttttaaataagccagtctgctttcataataattatattttaagccattttctgatgagacatttgtcatcatgagaacaatgtagtaaaagtttgttacactggggattaagatattagagtttccattcaagattccctaatactggaagaggttcacttaaattccatgattctatgagaggagtcaaatctgaggtgcaggctctgcaccttcccaggcctgcaggggctttgcaccttcttgcggaacagttgccagctgttatcgcttcacacttaggtcactgccttcactcaagtcttttttttttttttttttttttaggcagaatttcgctcttgttgtccaggcttgagtgcagtggtgcagtctcggctcactgcaaccttcacttcccgggttcaagcaattctcccatctcagccacctgagtagctgggattacaggcacccgccaccaagcccagctcattctttttgtatttttagtagagatggggtttcatcatgttggccaggctggtcttgaactcctgaccttgggttatgcacccaccttggcctcctaaagtgtagggattacaggcgtgagccaccatgcccggccccaagtcaagtctttttcacagccttggttcaccataaaactaaggtggacaattgtcatggacagaattgtgttgcctcaaatttatgttgaagtcctcacctctagtacctcagaatggggctgtatttggaaagaggacctataaagaggtaattgaggtaaaattaggttatatgggtgggccctaatcagtaagactgatttccttgtaagacaaggagatgtggacagagaccacacacagaccacgggacaatcatgtgaggacacagtaagaaggtggccattggcaagggaaggagagaggcctcagaagagaccaaatgtgctgattccttgatcttggacttccagtctccaaaactgtgagaaaagaaattttttatggctgcatagtattccatggtgtatatgtgccacattttcttaaaaatgatgagttcatgtcctttgtagggacatggatgaaattggaaatcatcattctcagtaaactatcgcaagaacaaaaaaccaaacacctcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacaggtatacatatgtaactaacctgcacattgtgcacatgtaccctaaaacttaaagtataataataataaataaagaaagaaagaaagaaaaaaagaaatttatgttacttaagccactcagtctgtggtattttgttatggcagccctagtaaactaatacaaatatttttagggacaacaaaccatggactttgttattctagtaagatgactttagcactattacctacttctaccttgaagtggtaaaaaaaggcagtgagaagcatttccatggaatgtataaatcgtgtcccgtgaaacagaattagctaataaggttaacacctgtcagctgtatatgatgctgcgtctccaatctccatccggacagcaaaggggaaggcatggacaggagacctgccttcagaagagcacctgacaaaggggcccacagcctggggacggtgacggcagtagccccccgaggcctgggatcccacagcacaattgtgaagggaaagtcttacttgctgggcccagatgtgtaattttctcccaccactggttttttgtgaaaaattcttctgaatacgtaattttgcccctaaataaacatggtgttggacatttttctgactaggaagttaggatatttgcttttctagcatctttattagatgactttttatgtttgcaaagtcactcagaaaaaacttcatcctcccaacacctccctggaccacagtccccacaaatgacattgaactcacaacataaaggaactcaccactaggtaaataggtgcttgactgtgatttaacacctgaattactaaaattgattgcaataattatccaaagaaaaacagccaagtgcaacagtaacgacagcctctgaactctctccacatcttcttgtggacagcctttgagctctctccatgtcttctctgggacagcctctgaactctctgcacgtcttcttgcagacagcctctgagctgtttccatgtcttctccgggacagtctctgagtctctgagctctttccacgtcttctccaggacagcctctgaactctctccacgtcttctctgggacagcctctgagctctctcttgtttgggacatcctctgagctctccacgtcttctctgggacagcctctgagctctttccacgtcttctccgggacagcctctgaactgtctccacgtctcctccaggacagcctctgagctccctccacatcttctctgggtctcctgtggagtctgatcacctttcagttaaggcatctcctgtgagcaacccagttggctactctgagttctgggggtagctgtccttggtttctctgaattgcccagaaaccaacctttctgttgcccatcgtagtgcctacgtggcttagctggagccctaccctgcttttgttgcccaaccaatgcctatgtgacagggctaaattcccattcagctttaactgcttagttttagaaaacaggatgtctggggtcagaagttccttcttaggactaaactggctgaagctggcaaaatccgcaatggcagcttgacctctgaaaaacctctagcttcattatgatccaatttccatgctaaatgacactcccactggcaccttgacagttgacaatcaccatgacaatggccagaagagaccaaaaacaggcagaaaagaggtggctctttgattccaaaaaaacctacctcccttcccaagaaaagctatgaatatttctccctttcctctgtatacccagccccttcattaagaatcctcagttctcaggctctgagaagttgatttgcaggctatgctcccacttctgcaattccatggccattgaaaaaagcccacactgtttgatactcactctcggtttggtgtattggcttcacaccaaacaagaaagagctcctttaggggtagtcaggaccctgattatattcccacatagaaactgttcccactcactactggcacagcagaacacataaactgtcagatggctccatttcaatgatttgacttgtaattctcaattgtttctgttcctaagattttaggactttctatcaactcataaaaaaaattttaaaaaggtaaggcaaccttcaaatctaagatgctcagctttaaactagtaagttcttaaggatgttttttttcctccaaggaaacaattctcctctttgctgagcaataatacaggttttaatattaaataagtacacaaagtaaaagaaacagacaaaaatgtcttcatagcaaggctgttaacagatttctttctttttttttatttttgagatggggtctcactctgttgcccaggcgggagtgcagtggcacaatctcagctcactgcaacctctgcctcctcagttcaagtgattctcctgccccagcctcccaagttgctgggatcacaggtgcctgccatcacgcccggctaatttttttgtatttttagtagagacggggttttgccatgttggccaggctggtctcaaactgctgacctcaggtgatccacccaccttggcctcccaaagtgctgggattacaggcatgagccaccgtgcctggccagatttctaatatatgtaaagaaaaaagaaaaattttcaaatacttgtttagataagtactgatatttaaaaaaacaaccaagcctaaatccctagatttacaatttttaaaaaataagaaaagcaatgtaattcacagaataaaatcttttggagtaaagtaatataactctaacaaattggtaaatctaggcaagaaatgacttgcccaagtaacagacctagtaggtggagagctcatctgactccagaaaccacactctacaaaataaacttattgacgtgaagtatgtatataatctgtaactggtgtgaaactgtggcagaaatacaaagagccgtggtcttgctcatgatgttcaaaggcaatatttgaactgagggatggctgtgtgaattgaagtggtcactggagaaacgtggttgagattgtgaaccatggggaacagggggtggtaattctggatttttggcatagaggagaaagaaagaactgcaaacatcattacagtgaaggagggtgaggccctccgaaaactgattgcgtttcaccagaaacactgatccagtgggggcagctgaagcacgaaaatgattagaaccagagtgatgtcacccacgtttctttctttttcttcttttttttttgagacagagtctcgcagtctcgctctgtctcccaggctggagtgcagtggcgccatctcggctcactgcaagctccgcctcctggggtcacgtcattctcctgcctcaggctcccgagtagctgggaccacaggtgcccccaccatgtcctgctaatttttttgtatttttagtggagagggggtttcaccgtgttagccaggatggtctcgatcccctgatctcgtgatctgtccgcctcgacctcccaaggtgctgagattacaggcgtgagccaccgtgcctggccgatgtcacccacgtttcttaggaaagacgttagcatcctctaaatcctcaccgactgtgcctggcgcagcattattttgcagttttctgggatttacagttggcatcatttgcacagcggcagcgtgacgtggctgtggagagcacggaagatctgtccccacggaagtgggctcttctggttgcaacatggtggaggccagcccggcctcaggtgagggaagatgccacagcaaacctctgagcaaccaagatgacaagcacctgcttggaaaaggtgacaagccacaaggccataggcccagttataaggatgaattgtgttacacgaatggttataaacctgaccgacctcagaaggtatatggaggaggcaattatcaagccccttgatggtctgtggctggatgcaccatactttgccaacagtgtgagcatggcagagaatgtaggtgtgtatataggggaaaacctccagaaagttttttctgtgggagttctttgtaaaataataacaatgcaactggaattatattgcaatctataaagggaaatcactcttagggatcaacattgtagaaagacaacttgttttttgcttctttgctcagtgttaagaagtcatcacatcattgtcaccctccccacattctgttctgtagtgcccgatttgttgaaagcagtatgaggcctgttttaaacataaatctattctaaatctaaatttgtaatacattctgaatgtcatttagacagtcttttgcctggagattaaaaattactttatttctagcaaagtgctctgaagtaaaatattttaacaacaaagaagatctgtgtttgttgttttctccattatctaattattgatatccatttcatctgggcacatataaatggtaaaaatatttacaagctttgaattaggtgaatctaattaaaaataaaatatagatgttaatagagcctggaaatattgtcaatatctttttaatagattgagccccgttgattatttcttctgggataaaggctcaaatttattctgtgaaattagacactcaaatcatctgaggcaatatatggcagatgaatatacactgattgatggaaatgttgctttaatgcacattgttcattgcaattttgcgtaggttactgaactatgaattactattgaggaacagcacattcaacgtgtcatagcaatcaactatttagtatggacattttctatgtttctagattttctggccactctgagcaaatttaaatcaaatgactgaagtataatcacttattttaactctgttaaaacagtcaacttgaaaagtatatttttctgtatgaattttttttctaattgactctattttgttctgataactaaacttatttaagttgcgctgttgaaaaaaactataggccaagcgcggtggcccatgcctgtaatcccagcactttgggaggccgaggagggtggatcacgtggtcaagagatccagaccatccgggctaacacagtgaaaccctctctctactaaaaaaaaaaatacaaaaaaattagccagtcatggttgctggcgcctgtagtcccagctattcaggaggctgaggcaggagaacggtgtgaacccaggaggctgagcttgcagtgagccaagatcacaccactgcactccagcctgggtgacagagcaagactctgtctcaaaaaaaaaaaaaaaaacaacaaaaacaaaactatatatatatatgtatatgtataatctgaagatccatgtcgattccattattttacaatgcagtgacattataaggaagtggaaaaattaagtcaaaattttttaattatgatgaatatagaaaggggatttcttgttgaaacaaataggctaaaagagccttgatgtcagctatgcctctcttagagaaaagactgtgaccctgtcatcccgttggataatctagtgatgcgctttaacagctattgttaaaatagattttaccaaggcaaggacaacagtttgcttatgagcaatgagaagtaagtagtcttaccagagtgcaccctttggaaagtgctgcatatataattagtgaggccattcataattcatttttattatacaaatgctgattaaatgtataccttcttccactcaaatgttaacgtgtcccttcctcaatatattttattaggctatgtatatatctcaagcatagattaatttgttttgtaagatttcaaaacattccttttttagccctgtaatgaatataaaatggatccctactgcccatcttagagaatgcgtgtttcatagaactgtttaaaaaataaatccttttaaattgcccatctgcttaagctatgtttgtggaacattaggactaagtcatgtctgacaaacatgtgtcatactactatttgagagcattactgcattttcaggaataaaataatattattaagaagtataatttttccaagtgatacaataagaatattgctagagatttgacctatttgtgaaaaatctttgcatgattattagcttcctaaaaataaaatgaactctgcaaatgtgatccaagctgttctgtatgaaattatgtgctagttgcacagtcccctgggagaccagtgtgagtccagatgcctctttgctggtttgtttcatttctggggttcattttctagaggtttttatcatattttcaaagtacagaagtcaggcatctcaaattcaagtcttgtctcccccaaactttaaaaaatatatgacattgatataatttggctggataataacaaactgaacaaataagatattttctttcattgaaggttggtaacattttcctcacttaaaaatttttggttgggcacagtggctcatgcctataatctcagcactttgggaggccgaggcgggtggatcacctgaggtcaggagttcgagtccagctggccaacatggtgaaaccctgtctctactaaaaatacaaaaattagccgagcatggtagtgcacacctataatcccagctactcaggaggctgaagcaggagaatctcttgaactccagaggcagaggttgcagtgagccaagattatcccactggactccagcctgggtgacagagcaagactccatctcaaaaaataatttaaaaaaatgaattttctaaattgtgggtcagaattcaagctaatggaaacctgtggaagaaggaattttgcaggtctgcctgtggaatccataattcttttcagaggcagcgatattacaaaaaaaaaaaaaaaagtgtgaggatgtccccaagcagaaaaccgccttcactgcaatgctgacagtatctgggtgtcccagggttcctggggagtgcaactgttatcccggctgtgctgctactgtgctgagtggttttatatccactgagaaggacgtgtcaacaggtggctgctcaggcccctaaagaatggatggatgtgaggtctctgtgaagcctctgggccagatctctgaggagtatctgtaaggggcatctcacctatggtgaggatgctgtgtgagcgctgcatgggaggcctcagtgccaggctcctggtgagaactctgagtgaggtctctgtggagcctcagtgtgaggtttctgcgtgagttctgtgtggaaagtctctaagaaatccgagtcagtttctgtacgaggcctgtgaggccacatgaggtctctgtgggaggactccatggggcagcaagagggctccattgcctcttgtgaggcctctgtatgaggcctttgcagaaggtctgtgtgggaggtatcttccagaggtctctgtggggtctctgtgggaagtccctgtgtgaaatctccgtgctaggtctctgtgtgagggaccatggactatatgaagtccctgtgtgaggaccctgtgtgaggaccctgtgaaagccctacagaatctctgtgtggaatgtttgagggaattctatgtgagaggtttctgggcaatgagtgtggagcaacctgaggcctgtgtgaggaatctatacaaggtctctgtggagagtgggaggtctccaggcaaggtctctgtgtgaggaggactctgagagaggtctctgtgaggcagtggggggtgccatgtgccatttctggggctggaggccagaggttgcagtgaactgcatgagtctctgcatgaggtccctgttttatgactctgtgtgaagtctctgaggtctttgtggggtctctgtgtgagatctccctgtgagaaccatggaaggtctctgacatttgtgggagatctctgtgggactgagtgaagtctctcagcgtggcctctgtggggttctctgggtgaggactctgggaatctctgtgctaggtctctgtggggcaccatgaggactctgagagctccgtggggtctctgtggaggctgcagtgtgtctctttctgtggcagtgagaggtcccagtgttctcactctgtacgagatatctctgtgaggttcctgtgggaggtctccgtgggtctctctattgttggcctcactgcatgtcatgggagactgagctgcagaagggctaaggggttgttgcttcctgtgttctttctggtctctcagcattgcctgtggcgcttctcctggtctgagccatgggctccaagtccagctcctccacatcccagaactcacgtcttggtttcctgagggaacccagcagcagccaggcatggcccatcctcagtggtcagggtcccagctctgtgccacactctcctgagctcctggaggaccggggctgctctctgctccaggtcccagctcctcctgctgatcctggctccgctgtcaccgctgggcccaccttggaggctgcttcagttatccaggcctcagagaggacctggccccaggagaagccacaggctggggactgtgcccactgccccctgcaccccggtgccggccagtcccacatgttgggggcagggccatttccattgtcatctagatcagtggcactgcctggcactggcctctccaccattgaaatgaggcccccggaagtgggcctcttgcacgcctgtatgtggcacaaggcagagaaaactccctctagagacctggctcctcctgtccatgatttgtggagacctcctgctttcccatatggacagggcccagagaggaggaaagctgtgctgaaagcagagggagacagcagggacggctcctgtcctgcccataccctgcccattctggacaggtcacttccagctcccttgtatgttcaaatcctgcctgcctgcatcttcccttgctggtctctggggcaagcaaggatgtcaggagccagggaagatttgctgtgtgaccccagctcagctgctgggccctagtaagtcaccacctttccccagggagcagtcctggggctacgtgtatattaaaggtcaccagacttcgactcatgcctggggttctctagtccttgcttttccacctgttgtcaacacatcctttaaaaaattcaataagtaggccaggcaccatggctcatgcctgtaatcctagctctttgggaggctgaggcccgtagatcacctgaggcaaggagttcgaggccagcctggccaacatagcaaaactccatctctactaaaaatataaaaattagtcgggcatggtggtgggtgcctatcatctcagccacttgggaggctgaggcagaagaatcgcttgaacccaggggccagagtttgcagtgagccaagattgtactacttcactccagcctgggcaaaacagtgaaactctgtctcaaaaaaaaaaaaaaagttcaatagattattatgtgcaagcttatcgaagatgttaagaaattcatcttccttattcacttcgccttctcactaatatggccctctgtgttgggggtaaatgtggtttttctaggggtctgtgatctgggagctggagcagagacagaccctggggtgtggccaggatgagacactaggcccctctaggcctatctaaggggttggaatgtcagagtctcctggctcacggcaccactgatggctccctcacacacgccactttgcctccttttcaattctctgtctgcatcccctgtagctctacagagtcccaccatcagaagcctctgcacacacaggcataccctactccattcacccagaactacttcactgaagctgagagacatgtaggtgagatagacaaaggccggtgacccaggagcagggtcattcactcatctggggcaggggagttcacggccctcagcaacctccataaaggctgcccccctgaccccctagcccccacctacacatgcacagagctggaaggtctgtccccactgccactccagagtgcgagaaagggagaggcagtgggatggggactctctgcttcgcatgttggctgagctaagagggcccatctccatcccagcctttgtcagggagagaaggggcttcccaggggcagacgttatctattctccaccaggatacccagggtcaagacttctcccacttctgaactcagggcccagcactctcccacccaaacttccactattttttgacacatgaaggtactcggctgtggcacttcctggagcctgcatggagatgttcagtcccgtgacatctctgcaaaccttctccctacagctgcatgaagtttgaggtagagtaagtagtggaaagatgggttgaaccttatttcagagtgggaccttcataggtttttctcatcttgtttttagaattttttgttgtttgtgtaaagacgatattacggaaacataaggttcagtgaaggaactcaggatgaaggtgggcttacagcaccactgtcaacatccctccatgtcctgtcgcatctggaaaccaagcccacaccaagcatggcacaaatagaagccatcaccctcttataaataaaaaaccatatatattgtggaatattaaatgttctgcatttactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgcctgtctctgttgggacaaccctggctcttgagagtggcttgttgactgctggctgcatagctcagtattctgccatgttctgagtagaagaggtgcctgtggttgcagggaaacccacagactggggcttgaaacttctgtttgtgctgatttaccttcgaggcatggtgcgcatggcaaagtgacattttcttgtccagcatttgtccaactgccgtcatgagaccctgagcttcagcactgctgctgtacacacatgatctgttttttactgttttttggctctcagcagtgactggtgctggcttgctttttttctttgaaaaaatccactgaaaaaattgcttgatgttttctccaaagtggcttactgaaggaggctgtttctttgatggcagtagctggacgccttcatcctgatgggtgtcttctgttttcctgactggggtaagttgaggagtcctcaatccttcaagcctttcttcatgtttttctaagttgggcttcctagacttctcactcttgtgaatagggggaaacattggcctttggctcttgcatgagccttgacagtttgggtttctgggctcctcttgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcggcacaaacttgaggctgggtctctgactttgtggccattccaggctcaaattcactaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctgggtgctgcctgtgaggctgtacgtgaggggcttagatggccacctgccctcctgtccagctggaggaggcttcaagggcccatgatcattccaagatgggattcctcgcggtgccctctggaactgcttccatgcaggtgaggaggccagaagactctctggcatgtgatcagatgctttggtcagcacctgctttctcagacttgccattggtggctttctaaggaacatgtccacctcaacttctgagccagccccagattcacaggtggctgaggagggaccagcaagctgcgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccgactcctcagaagtcacccccagaaccttccgtgggaagcttttcatgtccctggatagattttgtggggtctcacccagaatttgccccagatgtgggcacaggtccctctctagctggaacttcaccttctgtgcctccttgctgctttcacctgtggacgtggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtttcctcaacaaaggccattcagggtgctgagtttcaggtagggagagagcttgcactttattctgcgatgcagggcaagctactccagtgttcttaatcagggatggaaaagcaggagataggactgggaaagaagactgaagatgggcctgagcctcggcctgagccataggtgtgggcaggaattggggtgtggatgaaataaagggttggcggtgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgcaagagcctaggatctgagcacttctgaggtccgggcagctgtttcgagttctctcccatgttccagaagggttttgggtttgtggtgtcctgctcagcatccaatgatttagccaaattccccaaagaatttaagtgcttttctggggtcatttgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagaggatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaagtgccactgagtcacagtgagatggagttatcagtgtggagtcccgcaggggaggagcagtgaagccttttggaggaggcggagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcgcccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccatcccacaccctgattgcccaattctcctgctacccctcgccccagggttttactcccatcctctgtccccctggtctccccatcccaggtcagctccaggctgcctgtggcccttgggtcatgtcccagccctggtaggaaggatgcagggaaggggaagtgcctcacctctgcagttgtgaaagaaggtccgaagtctcctccaggcctctcgggcactctctaccagctggaaatcaggagactgggttagggcagtgagggaggggcctgggatctcacaggaggctgagtggctgtttctttagggaggaccatggggaattagaccctggaccccacccatctgtgtccaaagccacatgaccccgacgttaatagcaaggcatggaggacagggctttttcattcacaacaggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttccctccgggacagatgagatcaaattaactctagtgtgctctggcagagccttacctctcagactgtggtttttcatcctgcctctgggcctccgcctccgccctactggacactgggagacatgatgacgtacggagacaagatgacgcggagagacaagatgacaatgggagacaagaaagggcgagaagctaggactggctctccctctctgctccagcccagccgcagcatgctgcactcaggaaccgcatgactctctctgtcttgctcagggagctctgtgtgcttcctcccactcatgtttaactggatgataaactgcttttcttcttagaaaaacagcaagagggggctgggcgtggtggctcacgcctataatccaagcactttgggaggccaaggtgggttgatcacctgaggtcaggagtttgagaccagcctggccatggtgaaaccccgtctctactaaaaatacaaaaattaggcaggcatggtggtgggcgcctgtaatccccagctattcaggacgctaagacaggagaatcgcttgaactcgggaagcagaggttgcagtgagcctatatcactccatttcactgcaacctgcgtcacagagcgagactccatctcaaaaaataaaataaaataaaataaaataaaataaaataaaataacacacaaataaaataaaaataacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcgggggcccagcacaggccccagatcaccccacacaggggaggctgggccctgagccacctgccccagaaaggggctgatgagccagggctcagggcctggtctcggacagagacctccccagtctcatgactggtactggtgctgagtccactggtttgattttgccttgatgcctcctgtgctcccccacagatggactgagatcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggtcgggactgagggttccttacctttctcttcccaggcgatggtgagggtgggtcatcacaatggaagtaagataagtaggggagtaataggaagaagaaccccagggcaaacaccaaggtgaggaagatatccaacacccatggtgtggagctgggggcgtttagcgatgaggcactaagtaattttaaaggaaagggaagattctccatgtgaataggcacgttgctttcaagcaactgagctctgggcatccccgtggagactagggactggggcccaggcctgcgtcacagaggtggggccttgatgtcacaaagggctcctttgttggggaggggcagtgggagggggaggggcagagggagggggaggtgcagcaggagggggagggggagggagaggggcaggggagggggagactggagcacagcccctccccacccccaaagctggggatccctccaccatcccaccttctagatccctccttcccactaagttttgtcagtgatagccaattttctattctttctccctggaatatagatattacctggttccttttatctgttggagacggtggcttgaggttacctattttatagcccttgaaaatctgaagttctgaaattttggctatgaaccagggattttcattctcagaatctcgttcatcctcaactccagctttcccacactatgtttttgtcttgtatcaatccagggacaaaatgtaaatttcttttactcttatttagttttgcaaattttgaatagtaagttttaaaaaattatttctatctcactttcaatcaaagggaactacccacatacaattaagatttttttttgtcttttaaagttttatttatgtacttatgtatttattttattttaactttcaggatacatgtgcaggacatgcagttttcttacataggcaaatatgtaccatggtgatttgctgcacctatcaacccatcacttaggtattaaacccagcatgcattagctatttttcctgatgctctccctaccaccagccctccctcgacaggtgccagagtgtgttgttcccctcccagtgtccatatgttctcattgttcggctcccacttgtaagtgagaacatgtggtatttggttttctgttcctgtgttagtttgctgaggataatggcttccagcttcatccatgtccccgcaaaggacttgatctcattcctttttatggctgcatagtattccatggtgtatatgtaccacattttatttatccagtctatcattggtgggcattgggttgattccatgtctttgctattgggaacagtgctgcaataaacatacacgtgcatgtatctttgtaatagaatgatttatattcctttggatatacaataatggtatatctgccacagcctctgtactgcactgtggggaattctgcccagtgcaaaccacccagtctccctagcactggcgggggaaaaccaccggctagacccgcagtaatggcggtcacccttccccccaggaacttggtcttcttaggcagactccaggtgctgtgctggccagtggggattccatgctagtgggtcttagcttgtggggttctgtgggagtgggtctgcttggctccctggcttcagcccccttctcatgggagttgatggatctcctgcttcactggatttctgcgagccaccagagtatgcagaaactcctacagctcagtacctgcccaagtggctgccagctggagcccctgctatgggtctgcacagctttgtgcttgggacccaaggccctggtggtgtggactcacaaagggattacctgttctggggtttgcaaaaatctgtgggtaaagcacagttccctgggtgggtagcacaatccctcactgcctcccttggctggaggagggaggtctctttgccctgtgtagctcttgggtgaactgtcacccaactctgcttttccttgctctccatgggtcacaccaactgcctagtcagtcccaatgagggaatctggatacctcagttagaaatgcagaattcactcgctgtttatgtttgtctcagtgggggctgcagagtagagctgtttctactcaaccatcttggcccctccccccaattaaaataattcatatttaaaatttgtaattctaattatgaaacagttataagtagttaaaccttcaagtggtatttctgtaaatgtatagcatttacagttctggacttggtaatgcttaaagtgcacgataacttatgggactgctacataggcatacctcagagatactgtgggtttggtttcaggccactgtggagatgagctctttagggcagtgcccaatggaagtgccattgagccacattgagacggagtcagaatgcagtccagcagtgggggagcaatgaaggcttttggaggaggtggagggcaagccagacaatgggggtgggtatgatgggtgaggggaaaatgcaggtggcttgggtgaagggcgttctaggggaagggaagattctggtggccagttctgcaataaaacaaatatggcaataaggcaaatcacacagaatttttggtttctcagtgcatataaaagttaggtctatactatactgtagtctattaagtgggcaataccattatgtctaaaaaagtcaatgtacataccttagtcaaaaattattttactgtttaaaaatgctatcgatcacctgaatcttcaacatcaatatctttttgctggtcagtggccttgcctcagtgttgtggctgctgactcatcatggtggaagctgctggaggtgaggtggctgtggcaatttcttaaaataagacaacaatgaagtttgctacatcagttgactatttctttcaagattcctctgtagcatgcaatgctgtttgatagcattttacccacagtagagcttccttcaaatcggagacaatcctctcaaaccctgccactgctttatccactaagtttatgcaattttctaaatactctgttgtcgtttcaacaaggttcacagcatctacacctggagtagtttccatctcaagaaaccactttctttgctcatccaagttctcatttgttaaaattttgtcatgagatttcagcaattcagccacatcttaagatctcttcacatcttttaatcttagttctcttgctatttccaccacatctgaagttacttcttgcactgaagtcttgaaccctcaaagtcatccatgaggattggaatcaacttcttccaaatttcttttaatgttgatattttgacctcctcccatgaatcacaaatgttcttaattttaacctcctcccatgaattgcaaatgcttctagaatggtgaaacctttctagaaggttttcaacttactttacccagatctatcgaaggaactactatacatggtggctacagccttatgaaatgtatttctcagataatcaggcttgaaagtctaaattactcattgatccctgggctgcagaatggatgttgtattagcaggcatacaaacagctttaattttcttgtagttctccatcagacctcttgggtgaccaggtaaattgtcaatgaacaataatattttgaaagagatctttttttaaagcagtagttctcaggtgtgagcttaaaatattcatgtcgtaacagatgtgatgtcattcaggctttgtcccatttatagagcacaggcagagtagatgtagcatagttcttaagggccctagaattttcagaatggtagatgagctttggcttcagcttaagcccctaacaaaagagtcatcctgttctttgaagcattgaagtcaggcatttattttgctacctggctgtaaaagtcctggatgacatcctcttccaatataaggctgttttatctgcagtaaaaacctttgtttagtgtagccacctttgttgcttctcttagctgatcttatggatgacttgctgcagcttctacatcagcacttgctgcttttccttgcacttttatcttatggagaagacttctttcattaaacctcatgaaccaatctctgctagcttcaaacttttttctgtggcttcccaacctctctcagccttcagagaattaagaagaattaggtccttgctctcgattagggtttggcttaaggaaatgttgtggttggtttgatcttctatccaaaccactcaaaccttctccatatcagtgataagtctctttcactttcataccactcatgtgttcattggagtaatacttttaatttccttcaagaactttttcttttcatgcacagtttggctgttaggtgcaggaagcctagtttttggcctgtttcagcttttaacatgccttcctcactcaccttaatcatttctcacttttgatttaaataagagatgtgtgactcttactttcacttgaacacatagaggcctttgtagagttattaattggcctaatttcaatattcctgtgtctcagaaaacagggagacctgaggagttggggggatggaggaagggcagatagatggaaccattcagacacatatatgtatcagttaggctcattgtcttttggagcatggtttgtgatgccccaaaacaatgacaatagtaatatcaatgatcactgatcacagattaccgtaacagatataataataacaaaacatttgaaatattgcaagaattacaaaaatgtaacacagagatacaaaataagcacatgctgccagaaaagtggcactggtagacttgcttgatgcagggttgccataaatcttcaacctgtaaaaaatgcaatatccgagaagcataataaagtgaagtgcaataaaacaaggtaagcttgtatatgtatgcatgcacacaccagtatgcatccacctatccacacacaaatctttgtacaaacaaatcctgtattttcaattccaacaatacatcatttgcaccttaaaaatatctgtcaaccttgtagtatccttttctgtctttgttatcagggtaatgctggtctcataaaaaatgtttgtgttccctcctcttcaacttttggaagagtttgtaaagaaatggtactaattcttctttaaacatttgctagacttctccactaagctatctggtcttggattttcctttttcaggagctttttgaccactgactcaatatttttactcattatttgtgttgattttctatttcttcatgtttcaatcttaagggatgtatgtttctagaaatctctctatttcttctaagttaaacaatttgttgacacatagttgtttagactattattatcctttgtatttctatggtaccaattttaatatctgcttttttgttctaattttatttatttgaggcttctctcttttttcttagcctagtgaaaggttggtcaatttttattatttttattttattttattttatttttttgagactcagtctggctctgtctcccaggctgtagtgcagtggcgcaatctctgctcactgcaagctctgcctcctgggttcatgccactcccctgcctcagcctcccaagtagctgggactacaggcgcacgctgccccgctctgctaattttttgtatatttagtagaggcggggtttcaccatgttagccaggatggtcttgatctctgacttcgtgatcagcccgcctcccaaagtgctgggattacaggcatgagccaccgcgcccagccattatgttttcaaaaaatcagctttttgtttcattgatcttttctattgtttttctagtgtatttcatttacttctgctatcatcttcgttatttccttccttcttctaattttgggcttcattttttttcttttctatttctttgaggtttattgtttatttgagatcttttttcttcatttagcacttaacctgtataaacttccctgttagaattgcttttgcttcatctcataagttttagtatgttgtgctttcattttagtttgtctcaagatattttatttcttttttgatgttttctttgatctattggttgttcaggagtgtgttggttgatttccacatatttgtcacttttctaagttttctcctgtttttaattttcagtttcatgccactgtggtcaaaaagaatacttgataagatttcaatcttcttaaatttgctaagacttgttttctcccccaatatatgacctgtgtaggagaatgtactgtgtgtgctcaagaagaatgtgtattttgctgttttggaaagtaatgtcctgtatatgtctggtccatttgatctatagtgtagttcaagtcatctgtttccttattgattatctgtgtgagtgatcaatccattgttgaaagtgggatatggaagtcccctactgttattgtattatcgttgtcacttctctcttcagatttgttaatatttgctttatacaattaggtgttccaatgttgggagaatatatatttgtagtaattatatcctcttgatgaattgacccttgtatcattctataatgactttctttccctcttgttacagtttttgacttaaagtttattttgtttgttgtaagaatagctactctttcttttttttttgttccctgtctttcctttcagtctatgtgtgtctctaaaggtgaagtgaatctcttataggcggcatatatttggttattgttttactgtccattcagccaccctgtgtcttttctaatttgatccactgatatttaaagtaactattgataggcatttcgcagtttctttgttcttttatttctctcttgctgtgcatgatttgattattttgattattttctgtagtggtatactttggttcttttctgtgtctttgtattaattcttttttaaacatgtggtaaaattctcatttgtgtaactattacatgttttgtctttgtgattatcctgaggcttccataaaacatcacatgctctcatctgccacataaggatgttttggtcaatgatgggccacatatacaacggtggccctgtaaggttataacatttttattgtatcttttatatgtttagatatatttggatacacaaatgcttatcattgtattatagttgcctatagcattcagtatagtacaatgctgtacagatttgtagcctggaagcaataggttataccatatagcctgggtgtgtagtaggtggtattatctaattttgtgtaagtatactctatgatattcacaccatgacaaaattgcataatgaggcattattcagaacatatccacattaagaaatgtatgattatagttataatggtctattttaagttgatagcaacttaacttcaagcatatacaaaaccctacactttactcccctccactttttatgtttttttgatgtcagcgtttatttctttgtttattttgtagttatatttatttgtaatattttatgtcttttaaccttttaaaagttaaagtgattatactccatcattacagtattaggaatattttgaatttgactgtttagttacttttactggtgactttttataactacatatgttttcgtgatgctaattagtcttattgcatttcagtttgaagaactccctttagaatttcttataaagcaggcctactgacaatggactcccttagattattttggggggtttctgaaaaagtctgtaagtcctagccagagcaattaggtaagaaaaagaaataaaaggtatccaaactggaaaagaagtgaaagtgtctctatttgaagatgacatgatctcatatagagaaaattctaaaggctccaattaaaaactgttaaaattaagaaacaagcaaatttgcagaacacataattaacattaaaaaaaaacctgttacgtttttatatactaatagttgagtatcccagaaagaaattaacaaaacaatctcgggccgggcacagtggctcacgcctgtaatcccagcactttgggagtctgaggtgggcagatcacaaggtcaagagatcgagaccatcttggctaacacggagaaaccctgtctctactaaaaatacaaaaaattagctgcgcgtggtggcgggaggctgaggcaggagattggcgtgaacccgggaggcagagcttgcagtgagccaagatcacaccactgcactccagcctgggcgacagagtgagagtccgtctgaaagaacacgatctcatttacaatagcatcaaaaaattaactacttacgaagaaatttaaataagacagtaaaatttgtatataccaacaactataaaacactgatgaaagaatttgaagaagatacatatccctattactcagtgcgatctatagatgtaatgcaaccccatcaaaatttcaatggcatttttcaaagaaatggaaaaaagcagttctaaaatttttatgcaacctcaaatgaccccaaacagtcaaaacatccttcagcagaaaaaacaaaagtggaagcatcacattaccttattccaaactaaattataaagctatagtaatcaaaatagtatgctactggcataaaaacagacatgtaggccaagggaacagaatagagatcatagaaagaaataaatccatgactttacaatcaattgatctctagcattggtgccaagagtacacaatgataaaatttagtctctttattaaatggtgttgggaaaactggatatccacatgcagaagaatgaaactgaacccttatctcactgtacatacaaaaattgtctcaaaatggatgaaagacttcaacataggaccaatattgtaagactcttagatataaatatcggagaaaagctccttgatactggtattggtaataaattttcagatttgataccaaaagtatagacaacaaaagcaaaaatagacaaatgggagtaaatcaaactaaaagcttcagcacagcaaaggagacaaccaatacaatgaaaagataacctaaagaatgggagaaaatatttacaaactatacatctgataagaagttaatatccaaataaattaggaactcagacaattccaaaggatcttgtattagtctgttttcatgatgatgataaagacatacctgagactgggtaatttataaagaaaaaggtttggccagacacggtggctcacgcctgtaatcccagcactttgggaggccgaggcaggcggatcatgaggtcaggagatagagatcatcctggctaacatggtgaaatcctgtctctattaaaaatacaaaaaattagccaggtgtggtggtgggtgcctgtagtcccagctacttgggaggctgaggcaggagaatggcgtgaatcttggaggtggagcttgcagtgagcagagatcgcaccactgcactccagcctgggtgacagagccagactccatctccaaaaaaaagaggtttaatggattcacagttccacgtagctgggtaggcctcacaatcacagtggaaggtgaaaggtatgtcttacatgacagccagcaagacaggatgaaagccaagcaaaaggggaaacctgttataaagcaatcagatctcatgagacttatttactaccacgagaacagtatgggagaaactgcccccatgattcaattgtcttccaccaggtccctcccacaacatgtgggaattatgggaactacaattcaagaggagatttgggtagggacacagccgaatcatatcattctgccccagctcctcccaaatttcatgtcttcacatttgaaaacaaattatgcctccccaacagtcccttaacatcttaactcatttcagtattaactcaaaagtccacagtccaaagtcttatctgagacaaggcaagtcccttccagctatgaattcataaagttaaaagcaagttagttactttccagatacaatggaggtacagggagcaggtaaacatacctgttccaaatgggtgaatttggccaaaacaaaggggctacaggccccaagtccaaaatccagcaggcctgtcaaatcttaaagctccaaaatgaactcctttgactccatgtctcacatgcaggtcacaggtcacacttatgcaagaagtgggctcccatggccttgggcagctccacccctgtggctttgcaggacatagcccccctcttggttgctttcatggactggcattgtctgtagccttcctgtgtgcatgatcaagcttttggtggctgtaccattctggggtccggaggacagtggccttcttctcacagctccagtaggcagtacctcagtggggactctgtgtgggggcttcaaccccatatttcccttctgcactgtcctagcagaggttttccattagggcaccacccctgcagcaaaattctttctggacatctaggagtttccatacatcctctgaaatctaggcagagattcccaaacctcaattcttctgtgcacccacaggctcaacaccatgtgaaactgccaaggtttggggcttgcaccacctgaatccacagcccaagctgtaccttggacccttttagccatggctagagtagctgggatgcagggcatcaagtcactaggtggcaaacagcagggggcccctgaatccagcccaggaaaccattttttccttttaggcctcttggcctgtaatgggagggactgctgcaaaggtctctgacatgtcctggagatattttccccattgtcttggtgatgaacatttgggtccttgttgcttatgcaaatttctgcagctggcttgaatttctcctcagaaaattggcttttcttttctatcacatcgtttggctgcaaattttccaaagttttatgctgtttccttttaaaactgagtgcttttaacagcacccaagtcacatcttgaatgctttgctgcttagaaatttattctgccagctaccctaaatcatctccctcaagttcaaagttccacacatctccagggcaggggcaaaatgctgccagtctctttgctaaaacatagcaagattttccttgactccagttcccaacaagttcctcatcactatctgagacaacctcagcctgaatttcattgtccatatcattattagcattttggtcaaagctagtcaacaaatctctagggagttccaaactttttcacatttttctgtctttttctgagccctccaaactgttccaacctctgcctgttacccagttccgaagttggttccacatttttggataactttacagcagcaccccactctaccagtaccaatttactgtattcatctgtttgcatgctgctgataaaggcataccaaagactgtgtgatttataaagaaaaagacgtttaatggactcacagttccatgaggctggggaggccttacttatggtgggagactaaaggcacatattacacagcagcaggcaagacagaatgaaagccaagtgaaaaaggaaatcccttataaaacaatcggatcttgtgaggcttatttactaccacaaaaacagtatggggaaaactgctcccatgattcaactatctcctactgggtccctcccataacacatgggaattatgggagctacaattcaacatgcgatttgggtggggatgcagccaaagcatatcagacctgaagagatacatttctaaaggacatacgattgacaataggtatatattaagaaaaagatgtttgccgtcactaatcatcaggaaaatgcacaatgagatatcacctcacatctattaggatggcttttataacagtaaaaaggtaacaaatgttgctgaggatattgagaaacaaaaacccttgtgcttagttgatagttgatgggaatgtaaattggtacagccattacagacaacagtatggagtttcctcaaaaaattaaaaatggaactcccatataatccagcaatcccacatctgggtatatatccaaagtaaagaaaatcactatctcagacagatatatatacttacaggtttattacagtgttatttacacagccaaggtatggaaactacctgtgtccattgacagatgaatggatgttttaaatgtattacacacacacacacacacacacacacacacacatatgtaatggaatatcatttagcctttaaaaatgaggtaatactgccatttgtaacaagatggataaacctggagtttattatggtaagtaaaataagccaggaacagatgcaaaaaaatcctgcatgatttcacttatatgcatactaagaaaatgtcaaactcatggtaacagagtaaaatagtgcttactagggcctgggagttgggggaaaagaaaaaatatttgtcagaaagtacaaactttcagttataagatgaataagttctgcagatctaatgtacagcatagtgactaaagtcaataataatgtatacttgaaatttgctgaaagagtagatctcaagtcttctccaccacacaaacacaaaaaggtaaccaggtgaggtgatgaatatgttagcttgattgtggtaatcatcacttcacaatgtatatgtatatcaaaatatcacactgcataccttaactatatacaatttttctttgttaatcaataaaactggcaaaaatatcttttacatgttgccttgactccatttcttattttgtcaaaatagatagtcctcactgtttgcataagtttagaaacttgtgctatatccagaagtcaggagtgcggtagggtgaactaagttactgattctttaggaaccttagggtgtgaggtgggactggagttcaaggtctaggagctcagtctggtcttgagcagcttcttttttgttttgttttgttttgttttgttttgagactgggtctcacattcttgcccaggctggagtgcagtggcaaaatctgggctctctgcaacctccgcctcctgggctcaagcaatcctctcacctcagcctcccatgtaacgggaaccacaggcatgtgccactagggctagcgaatttttttgtatttttggtagagatggggtttcccttgctgcccaggctggtcctgaactcctgagctcaggtgatccacccaccttggcctcccatagtgctgggattacaggtatgagccaccatgcctggccatgagcagcctcttctgatatccctagagtgttctgtacacattttctttgtctgaatgcgccttcctttctctctattggtctacagattttttccttctttaggatattattaacttgaattcaaatttttatcaaaaattggacctagctctttttattcatattttcctgctatattttttacactaatttattttcgataggttttattgagtgtttttttgacacttaaaaattttacctgacaatcttaatctttgatttatgtaattattgttccattatgacttatttctgtcatctcattttatgatttttcatactttctttactgtttattttttcctatttgtacctttcactctatagatcaaatctttttctatttgtttgaaatctggaaatttttaacattgtaatggtggttatatcattatttatgttaattttctcaatttctgatatgtgtcaaaattaatatcatctcagcaaaccagataagtgctctagcctcctctggccacctctggtttgctttctctgttacaacagcactttgtctaaggggatgctttctgaagtttactcggggtttgttttcaatatgttatgttttcatgtattttttagggtatgataaacaccactaccattgattctggaaccctcaattctaacaccacggtgtatttctcttcttagtggagtatgtcctctaagcattttcaaagggatttatttgaaataaaacttttcaggccttactttttaatgtctttttctgggctttcatatttaaaagattgtggctgcaaataattcaaggattaaaattggtttccttttaatccttgaaaaatattacttcattttattcttgtctccagcattgccgttggaaaggctgacgccaatcaaaaccaatttttccctaaaggatgatctgtcttctcatcattttgacaggatgtaacaaaacaaaggagtcttcaatgttctgagtataaatcattttgcaattataaacttaacttaaatattaatgcaatacaaaaagaattaaaaccttcttgagacatgcaagtgcacaggaaaattaagtatcatgcactcattcaggaagaaaaggtgcaaaagaaattgaatgaaagagatggtcgttagatgcaagtgtggttgaatgtagggatgcgatgctgacacgtggcagcaggcctggcaagctgtctgtcccaattcaacgacttcagaaagagaagaatattaactaggctatcttggtgatgtgctgaaaaaagtgctgtgtttcctttttaatcattcaaaacaaaggtagtaaaattcccgggaaataagaaataatgcatcataaatgtataaaagttgaggaaaatactatatttttatgaatttaaaatgccatctcatttagattgttatgtcttttcagaagtgctttaaaattgatggcatatagtaaaaaatggcataaattccaacaattaatggaaaaacattaatccatcttcttgagtcttggaaccaggattcttttgggaggcttcggtgtatctgtgtatcctttcattgccttcagacaaatcaaatcacgccacctgcgactgtggtttgaaaaaaaaagaaaacataataatgatgctgtcaattcacttgagattccatgatcaaaattaacctacgaacaaagcacagactttattataattacaaaataggatgtaatttacataaaatgtgaaaatataagcatagaacgaaatttgatacaagtcgaaagctatgacagggactgttggaggggagggaagttgtacactaatctccacatcctactgagccaatcagtggtgttcaaattggatggaccatatattatctaaacagcatattatttaagcaaagaattaagcactgtaagtatattatttagagaaagcaaatttttaaaaaatcccataaaattatatattaaagactaaattggaaatatagttttagaagaagaaagtagggtaaatgagctatgttctctaccgttcataaaaagtcaagggatattacttaaaattgttaaaacaaaattaggtgattgtataatattatttacagttcaagagaatagcatatagtaaaaaaagaaaatgataaaccttgcctaactctgaaaaacaggaccaaggtctgtggaaggaaaaaaaaattttctggttttcactggttttttgcccatgaaactgtttgaatgattttcaatgcacgtgtgttggtttaattttaaaatgttcttacttacagatccccttgaattacgtgtaaaattaggtttcctttagtcaatggtgtatgaaaagtaatcaactcatctaattgaagttagacattaataaataataaattggggagaacataaatatactcattaaaaacaaccagaacatagcacttggctctatgttctgcttatctaggaagtggaattcttaaaattaaaacaaaaaaataaggagcttcacattttctttttcttctttttttttttttttttttttttttttttttttttgagatagagtcttgctctgttgcccaggctggagtgcagtggcacgatcttggctcactgcaaccttcacctcctgggttcaagcgattctcctgcctcagcctcccgagtagctgggactacatgtgcgcatcaccacgcccagctaatttttgtatttttagtagagacggggtttcaccagattggacaggatggtctcgatctcttgaccttgtgatccacctgcctcggcctcccaacgagctgggattacaggcatgagccactgcacttggtcggagtttcacattttctaaaaaatgttagaaataaaaatgcaagtgtttcacctagataaagctctcataatcactggtagactaaagtcaatttagattaccatttatattttcaaatttataatatgaccaatattgccatgaaaatgttcaggcacagaatggtttaaagtagctgtcttattatttctcaatattctcttttcttctatgattggcatcaccaatcatggttggagcatcttttttttattttattttatttatttattttgagatggaggctcactgtgttgcccaggctggagtgcagtggcgtgatctcggctgactgcaagctccacctcccaggttctaaccattctcctgcctcagcctcccgagtagctggcactacatgtgcacgccaccattcccagctaattttttgtattttttagtagagacagaatttcaccgtgttagccaggatagtctcaatctcctgacttcgtgatctgcccgcctcagtctccaaaagtgctgggattacaggcttgagccaccgcacccagccatggttggagcatcttaccaaagaactatacttgtagtttttgagtggaaacaagggagaaattttattcatgccttgaacttattaataatgcgtaactagattctgatggccgttatcaatagaactgtcatcagattcaaagagcactgtttgtctcctctaatatggagaaatgccacaaataagtgggaaataatttaatgactgtagttcatttttaatcatatagctgagtgatattttaagtctgacaagaatagatatttgaacaaaaatagccaattctctgttacataatttaatacatttgtgttaagaggtttagacaataaagttaattttgaaatgcattataataactgagtaattagcaatcattaagttcatttttaaataagtgtttagataactaattagcaatcattaagttcatttttaaataactgtttagtccacaaaaaataaaaaatgtattttagaaagggagggcattccaaaatctgtctcaggagcattcaatctcaaatatattttaatgaagcagaaatgtaaatacatgtttagataatttaggttaaaaaaggtaaattttggttgcctgcttaacttttatgaaacagatatttttcattcaagtccagcatatattttgctatgactttcacatcctttcctcagagactatttacctaaacattagggtaccaaaggaactaggaaacaaaaacttgttagagagagaaattttaagtgaggcgcacattctggtgacattaatttgtttttgacattttattaatattttgagaacactaagaaaataaaatccaaaggggcaagcaggtatcattgtctcagcgtgggccctcttttgtcatcctctgtaagatggcagtcatcaaagagcgtgacccaagaagaaagtaaaacagtggaacaaatgagcatttctctaaatacaaacagtagagtccctgagaaagaatcctttaaggccttagatttctttaaacatttttagataaatagtctggcctatgcagaacaaaatgaaatggtgataatgaacaggatagtgaagttttgtactaactgacataaacgacgagttgattaatgcttaggatagtgtgaaagaagaattgaaagcaaaatgcaaatcaaaagaagaaatatccagacagaccctttcctaaaacatgtatcataaaatatttaaaagcatctgctttaatgcatgggctgagtcaaagtaaggcaaattttcagatatctacaagagcaaaaaaagtttgaatccagaggtgtgagtgcctcatctggcatttgccctggggtgtctcccaggaactattggcccagaaccatgagcacctaattcaggaaacagagactgatgcccatgcagggaggagtataggctaaaatgccttctgcataaatctaggatttctaaagagaagcatgttaagtggggctaggaaaatcccactcccataagaagaaagtgaaaaatctatgcttgtcttggtttcaatagggtagacaagaaaaaagaaaaaaaaatggtaatttctaaatataagtcaatagacatattggtttggatttgaattcacactatctatgggcctgagaaataccaggatggaaattagcctctggcagtgagaggttaggccagctgcacttcctgggtcgagtgcggacttggggaactttcctgtcctacaaggaatttgtaaaatgcaccaatcagcctctgtaaaacacaccaatcagcaggattctaaaagtagtcaatagtggagaggattgaaaaaagggcactctgataggacagaaacgcaacgtgggcgggaagacataaggggataaaagctggccacctgcaaccagcagcagcaaccaggtggggtcaccttccagggtgtggaagttttgttctttcgctctcagcaataaaccttcctagcctcacttttggttccgtgtcatctttaagaactgtaacactcaccaggaaggtccacagctgcattcttgaagtcagggagaccacgaacccaccggaaggaaccaactctggacacagtcctgcaaactagttaatctgagtacaatcataaagagaaatatattttgcactaatactgggaaacagattttgtaacacagctttcattgttgttaagtgaagatagtatattttacaataagcaacactgggaccactgatctccataagggaaaaaaatgaaattgaaacttaatcccggagaacaaatataaaaatatattttaacggataaagatagcttctcaacatttttagaaaaaatcctgggaagaattattttttcttttttgagatggagtcactctgttgcccaggctggagtgcagtggcgcggtctcggctcactgcaagctccacctcctctcccatgttcatgccattctcctgcttgagcctccggagtagctgggactacaggcgcccgccaccccgcctggactaattttttgtatttttagtagagacagggtttcaccgtggtagccaggatggtctcgatctcctgaccttgtgatctgcccacctcggcctcccaaagtgctgagattacaggcgtgagccaccgcgcccggccatatcttttatctttacatggggaagaagaacaaactgaaagaggaaaaattgatttgataacacaaaaatttaatacttctgtttattaaaggatactgcaaagtgaaaaaaaatacccaaaacttggcagagctatttgcaacacatcttacctagaaaggtctggtatccagaatatgcctcctataaataagtgaaaaataacatgtccgttgagaagttagcacaaatagcccataagcatgtaaaaagtgctcaacctcataataatcatgaaaatgaaaattaacaattagatatcctttcacacatattgacaatttttttttgaagttccgaaacgtgtggtattggcaaggataaagaaccatggaagtattcatcccacacgctaaagtaggacagccatttggaaaacagacagatgctggctcatacagctgatcataatgtaccctatgacccagtgacttcactacaacctagtgcaacctagtcagcctgttacaggccccagaaaaattcttgcgtttgtttacctagagatatatgagaatgttcccaattttaaaaacctggaaacaatctagttatctctcaatatgggtagatagtggactgggtaattaaatgatcatatattccaataatagagtacctcgcagcactaagagtaaatgaactgcagctattcacattctcaaatacagcactgcaatgagatactactgcatgcgtattagaatggcaaaaatccagaaccctgacaacaccaaatgctgatgaggatgtgaagcaacaggagctctcattcagtgctgatagaaatacaaaatggagaacagttttgtggcttcttagaaaactaaatctactcttattatacgacccagcaatcttgtttcttggtatatatccaaaggagttgaaaacttatgtccacacagaaacctgcacacagatgtttatggaagctttatttataattgcaaaaacttggagacaagcaagatttccttcagtaggtgaattaacaaactgtggtacatccagacaattgaatatcattcaatgataaaataaatgagctgttggccgggtgcgatggctcacgcttgtaatcccagcactttgggaggccgaggcaggcagatcacgaggtcagcacatagagaccatcctggctaccacggtgaaaccccgtcgctactaaaaatacaaaaacttagccaggtgcagtggcaggggcctgtagtcccagctacacgggaggctgaggcaggagaatggcgtgaacccgggaggtggagcttggcttgcagtgagcggagatcacgccactgccctccagcctgggcgacagagcaagactccctctaaaaaaaaaataaaaaaataaaataaataaaataaaaaataaaaagagctgtcaagccacgaaaagacacagaggacgcttatatgcatattacaaagtgaaagaagccaatctaaaacggctacatactgtcacttccaactatatgacctttctggaaaaggtaaaactatagagatagaaaaaaaaaaatcagtggtttccaggagttaggaggaagagaggaatgaataactagagcacagaggatgcgtagggccctgaaagtacatgtatgatattttaatagtgaatacttgtcattgtaaatttgtccaagcccgagtgtgaaccttaatgcaaactataagatgtatcatgtaggttctttaattgtaacaaatgcaccactctggtgggggatgtttattatgggggaggctatgcatgtgtgggggacagggagtatatgggaaatctatacctgctgctcagttttgctgtgaactttgaactgctcttaaaaataatgtgtgtatgtgtatatatatataccttctgctcagttttgctgtgaactttaaactgctctaaaaaaataatgtgtgtgtacatgtatatatatatatatgcatacacatgtttgtgtgtatgcatatctaatcacaagaaacaatacatagttggccaggcacggtggctcacgcccgtaatcccagcactttgggaggccgaggtgggtagatcacgaggtcaggagattgagaccatcctggctaacagggtgaaaccccgtctctactaaaaatacaaaaaattagccaggcatggtggcaggcgcctgtagtcccagctactccggaggctgaggcagaagaatggcgtgaacctgggagatggagctttcagtgagctgagatctcgccactgcactccagcctgggtggcagagcgagactctgtctcaacaaagaaaaaaaaaacttgtaaacaaatgatgatgaaaataagaaactgaatacaattacgaacaatgaatttaatcattagtttcttctgcattatactatatgtgaatttgttctagaaaatacaacataaaaggaaataagtaaaaaccaaatgttgagcattactaaggtaaaaatgttgaatggaatactttattatttatttatgtatttatgtatttatttgtttgtttattgagacatggttttaccctgttgcccaggctggagtgcagtggcatgaccatggctcactacagtcttgaactttcatgctcaagctatcctctgaccttagcctcctgagtagctggaactacaggtgagtgccaccatgcctggctaattaaaaataattttttttttttttgtagaaacaggctctcactatatagccagggctggtctcaaactcctgggcttaagggagactcctatcttcatctcccaaattactgggattatagatgtgagtcatcaggtgtcgcctgaatgatatattttaatgatgtacctagcacatgagtttcaaagttttcactctccaagaattttcataaggtcagtttaattattaatagcatgttttacagttatagaattaatgcataaatacagtaaaacaaaacaaaatgtgaaactatagaattgtatgaaataaaaaataagaatatttcttctgtctctatacattttccatctttaccatgttcaacatatctttattactattattataaaaaatttaagaatatacaaaaggaaataaatagcataatgaatgaatagtataagtaactcgttgacctaatacccagcttcagttttagacagtcctgattcctctgatcccacttccctgacatagattaattgaagagcatttctggcatcctatcatttcatccatgaatattttagtatccacctccaaagggtaaggatcccctttttaaaataatacatctaaaaaattagccagaattacttacttttaaccaaaatccagtcgctgttcaaatttccctgattgtcttactttttttttttttttttttttttgagatagagtcttgccctgtcacccaggctggaatgcagtggcaagatctcggctcactgcaacctccgcctcctgggttcaagcaattcttctgcctcagcttcccaattagctgggattacaggtgcccaccaccatgcctggttaattttttgtatttttagtagagacggggtttcaccatattggcatgttggtcaggcttgtcggccaggattgatctcctaacctcaagtgatccacccaccttggcctcccaaagtgttgggattacaggtgtgagccacgctgcctggccagtcttacatattttttcacaccatttttcttttttttaaaagagcagaatccttgtacggatattacgatggattgcagagtctctaaagcattcttcattcttattcttccccttccatctttttttttccatgcaattctttaaagaaactaggacagagtccacagtgtagatttttatgattgtgtcatcactgtggtgtcatttaacatgctactctgacctcagtattatctgtgaaacccacatctcaggggtgttgggcagatttgtttgcttcttgttgtgttcccaacactcagactcaggacctggtaacaatcccctatagcagttcataactatttgcttaattttgactgaacaccagagggcagtgcaggtggacaccaagagcattgctgtcaacacacagaggcctgtgggcacaggggtcctgcactgcgaggccaaagctcccttctctgctcctaagcaatccatttccctcctctgaaggacagccacatactctaggtcctaacctctggagtgcactaatgaccaagaggtgcatgagcaccaaatgtgagagtacaggagtctggaaacccagcacaggagtcttctcagaaccttaggacattcctactgttgtgagggtaggagaagaatgcctagctaaggaaacaagtgtttagtgtccaatgtgagtaagtgccatggggaagaataaagcagggaagggcaagaagatgcccagggtggacaaagaagctctcactgataaagagacattagaacacgcatctgaaggtggcgagatagtcagcctttcagatatctggagcaagcttgttgcactaagaggaaaaagcaggtgcaaaggccctggggcaggaacatgctagttttttttgaggggggcagccagctgttgtaactggaacagagagagaagggggaagatggtagtgaatgaaatctgaaaaggaacagattatgtacgatttttaggccattataaggactttggcttttactcctgtgaatcagaaagctaagtgactggggtggggtagtgctttactaagaggagtggcgctctctgataatttttaaaggatcactctggttgctgagttacaaatacatagaatgtgtcagctgggagatcaatggggaggtgattgcaatcatctggggtggctgctacaatctatgttagaaacttgcatgtttcatgccttttattctaggcaagttcatcaacatttgcttttcagatacttaatgaatctttcagtctatttagagaataaggcatgtgttgaaatgatcagtacacagtattagaaaatggaaagccatgagtataataacagagacgcctttaggggcaaagtgaggtcaggagaggaagggactgcagccagcttggcaggtgagcatggcataggacaggccttccttgagatggtcacaaatacagttttatcagttttccttgtgatggtcacaaatacagtcttatcagttttcacaaataaaaccttacaaatgttcactaataaaatgctacaacatatcgtataccatatgccaatttaagataggttttactccaatgagttaggttatctgtaaataacacatggtcaaatcccatatgtctgtgtagcaaatactttctcagtgtcctgttgtttttaatccagcatgttccaccagcctggcctaggctagggctggcacctagatagtcattagggtaagtgtgtgtttgttttggggtgtgtgtgtgtgtgtctgtgtgtgtaagactcattggctctactctcagtcccctctatcaaaatttctggaggtgggaatcaagtgtgatactgatttggaaaccacaaattcagttcacagtcttctagtccagtctgtaacagctgccttcatgacaaactgaatgttgaaagctttggaaggtgccggtaaataaaaatagaggtggagggaaagccatttcagacaaaggggatagagcactaaaaaacataagagtcagaccggattggttttgcagtgacttctgatggcctttgcaagtgttccataactggatttgcctggaatgtggggttcagggtccttggaagagagtaggtagaaataaggttttggagcgtgtgaaattagattgtggagggcctcacatgttgagcaaagaacactaaagtttattttctaggtaatagggagccaatcaaaatttttaaaatgaatgatgacaccacagaactacggttcaagaaccccacacatctgacagtcgtgtgtaataataactgttgtgttaagagtccagagatgagaaagctttctgcattcattcaggagagagggggttgggtgcttaaataggaataggccactgggatgtgtaggttggaatgaatgtgagagacagaagatgtgaacagcagaagagaaaggacaaggtccaatgtggcactggggttttaaatacaggaaattgggaggatgaaccagcagccttagcaagatacagaagaaaagagatttaggaaaaacgtagtatgggtcagccagatttggggatgctgatgccataaccaactataaccaatggaagatgatttaacacagttgtaagtatcttgaagccaatggtctgtttagatgggaaacagtctttcattttcaaatttaaaactttattcttaaaatgtgtacatttaatccagaataatctatggatatgtactgaataaatgtgttcatttttaaatttatatttgatttgtagtgtcccatttcactatagttttctgaagaaatctcagttctttatgcaaactgtatcataatagtcaagaatttaagattactttcgtgttcaaggtcctatctccaattatcctcttgtttaacatgattgccttttgacctactttccatcttaacattaacattatatttttaaattatcctgaatcaaatttcgatttaagaaactccaaaaataacaaaaattggaaacagcctataacattttaggaaatcaagaaatatatttaattgtaacacccagtttcatactccacaagagaaaaataaagcaaagcctgatcaagacgtgcctttaacacaactcaatcacctttgagccttcattctttaccagtctctctagtctctgtgcctattttctactctccctgagcagaaatttaagtgtcatattttgccaaggcctccattacatgagtaatgagtgcttacttatattgatatcccctgattttctattggtgaagtttccaggaacattcattcttttgggaggagtagagactcacgtaaaggtcatgttatgtctcttcatcttccatccttcagagactactggtggccagaacacctatgtgggagagtgggtatgggaagtggggtgtgtggataaagaaactctgttcgggagaggctcccagggatctgtgagtcagaggagtcacctatctttagggtcgcacaaatctagcaccttctatgaaaactgcattcacccagaatgtgaaaagaaaaaagggatggctgagaacttttaaaattcagcaacagacacctgcccacaaatcaaagaagctcggagaacaccagatcctactttcctactgtcataaattaggtagttttttttttaaataaaaagatagggccgggcgcggtggctcacgcctgtaatcccagcactttgggaggccgaagcaggtggatcacaaggtcaggagattgagaccatcctggctaacacggtgaaaccctgtctctactaaaaatacaaaaaaattagccgggcgtggcggcgggcacctgtagtcccagctgctggggaggctgaggcaagagaatggcgtgaacccgggaggcggagcttgcagtgagccgagatagcgccactgcactccagcctgggtgacagagcgagattctgtctcaaaaaaaaaaaaaaaaaaaagatagaaaataacattaaacttgaaggacgctttaggccaaatggacctaatagacacatacagaaacttcacccaaaagcagcagaatacacattcttctcagggacacatagaacattctgcaggatagacaacaggttagaccacaagacgaatctttgcaaatttaatattagaatcatatcaagtaccttttcagacaacaatgatatgacactagaaaccaacaatagaaggaattccagaaaatgtacgaatacgtggaaactaagcaacatggtggtgaaccaccaataggtcaatgaagaaatgaaaattaaaagaattaagcaacatgctcttgaacaaccaataggtcaatgaagaaattaaacaagaaatgtaaaaacatcttgagaaaaacaaaaatggaaacacaacataccgaaacttatgagatacagcaaaagcatttctaagaggaaagtttatagcaataaacatcaacagcaaaaagaagaaagatctcaaataaacaacttagtattacgcctcaaggaaatagaaaaaggatatcaaattctttcaatgttagcagaaggaaataaaataataaagatcagagcaaaaataagtgaaatgaaaactagaaaatgacacaaaagatgaacaaaactaagtttcttaaaaatataaaaccaataatcttttagctagactaagaaaaaaggagagaagactcaaataaataaaattagaaatgaaaaaggagacattataactgataccacaaaaatacaaaggatcataagagactgttacaattacatgcctttacaaaaatcattttttcattggcaacaacattggaaaatattacgctaaaagaaataagcgaagccaaaaaagacaaaaactgcatgttctcacttatatgtggaatctaaaacaatcaaactgtaagaagcagagagcagaatggtcattagcagaggctggaggtgtggggtggaacggatattggtcaaaaggtacaaagcctcatttatacaaaaggaataataaggttttttttctttgagatatatcgcaaaacttggtgaaaatagtacatagtaaagaattctacattttaaaaatcactaagacagtaaatttcaaatgcattccccattaaaaatgacaagtatttgaggtggtggatgttaattagcttgatataattattccaaattgtattcataaattatatcatcattttgtactccataaatatacacaactatgatttgtcaatttacaatttaaaaataaaaattaaagcacaaaacaagaaaacacaatacatgtgtgtgtacctatgcatgtgtgtgtccatagaagtgcacacacacacacccccttcacctccattactttccaaagtggacaaatgtgtaattattttgacttaggctccaaatatctaatctaattctaatatttccttgcagaattatcagtgaccacttgagaaaggaagagctagctggcagactacatcagctcaggattttttaaaaatgactttttaatttgtgtgtgtgtgtgtgtgtttgttgttgttaatgagagctggaggtaatgttcatcagcaatggaaatgaactctggcggtcaatgcttccacattgtctaaaacctgcagctgaaaataatgggcgttattcaactgtaaactatgcttatatcgtctttacatccataattctctatatcttgtgctgtctgatataagagaattcagaagaaattctcataaagcaagttgtctctttaagagttatcagtcatgtttcactagaaaagtataaaacacaaagttacaataaaatgacattatggagaaataaattcaatagatagagctgatatatat
